United States Patent 9,492,524 (PLAGUE VACCINE) - sequence listing, part 3

SEQ ID NO: 19 - DNA, 4744671 bp, Yersinia pseudotuberculosis (residues 3,163,115-4,744,671 of 4,744,671)
cggcagctcgttaaattttacacggattatatatgcagtctgtaccctctatttttgtgagtattgcaagttatcgggatcctgagttgatccccaccttgcatgacatgataaataccgcagagcgccctgaaaatcttaatattgcgattttttggcaaaatgataatgacattaataccttcttaaatcagggaatgcagttgattgagcgtaaaactcatcagggctatccactgtaccagttggaatacaaccgggcgcgggtgtcggtactcagtgtgcattactatgaaagtagaggggcatgctgggccaggcacatggccgaaaccttgttccaggatgaagcattctttttgcagatcgattctcactgtcgtttcattccacactgggatcacgaaatgatcgcgatgttggatagtctgcgcgctgaaagccctaagcctatcctctccagctaccctcctgcgtatgaacccggcgagaatgagattcggaaagattatgtcagccgcatgatatttaatctctttacgcaggaaggtatcgtgcaaatgctatcaaccaccatcaccgaaacggcccccgtgcgttgtggttatctggcgggggggtttatttttagtgacggtagttttgccagagaggtgcccaacgatcccaatattttctttattggcgaagaaattgccatggcagcgcgtgcctttacccatggctatgacatttacgccccacacaaaattctgctctggcatttctatacccgcgcggagcacagtaaggtttggtcagatcacaataatgaagccaaagaaacgggtgcagtagatatggcctggtgggagcgcgataaaattgcgaaagaccgggtttgtaccctgttagatggcgataaagatcaccgcgtactcgccccctataccttgggcacccagcgttcattgtcggaattcgaataccgtctgggcatcaatattaaaaaccgggcggtgcatccggatgccgcgggtgaaaaaaaagtgagcttcttcactgatcttcccacatcccatgaagactggctttcctccctgattagcgtaaataaaaaaacgctaaaagtggaaaagaaagaggtggacttcacgcgagaggatgtggagtggtggcacattggcgtttataacccgcaaaatgtcgccgttatggtggaaaaagttgacccgcagaacctgagcaaaacggttacccccgttgacgaaaccacctttgagttgaagttggcctttaatactcaaacccatccgaatgcacaaacaattagaatatgtccttacatgcgaacgcaggggtggggagatgtcgtggagaaaccctggtgagcagcgcagatatttttaaaaagattttaagtattgacaccttattatcattcgatggtgtcatcccttcgttatccgagtttcagctaaagctggtcaccctgattgaacagtttggccacgcgctgcaatccgagggacataacgaaactgaagttgatcgtttatgtcatcagatttgtcactcgcttgataaacgtgcgggaagtgcaattaaagagaacggattgagttgggaaggctattcattagtgcattacttctacggctacatcgcgcctgtccctagcgaaagcgaaagtttagaagcgctattaaacagtgacgatgccacagtcagtcaattcgcactcaagatacttgccctctcgcagaatttaccgatccacgatgaaaaatcattgcagctactggcgcgctatagccatagatccttgcgccaaaatgtcatcgccactgacgatgatatcgacccagaggagtggctgggttcagcgctaaagagggaagaaaccattgaggcagaacaagtgcctgaggccaatatagtatctgaggccaatatagcacttgaggccaatatcgtatctgagcaacgccgctcttcgcgccctttttatctgcaacttatcacgctgacgctattgctctctacgctctggttctggtgctctcgctatttaggtgatctgtcttaaatgtttaaggttaaattgaataaaacgctctctctattatggctggctgcggtcggcaccctattggtgagtgtgaattttaagggaaatgcgttatggaataacgttattttcattactttcctggcgctgatggttcttgccatctggaaacattacgccctcaaacccaaacccccccaagtgccgattcccgtcccgcaggagacagcagaaccggtagaacaggaaagtacggttattttaattctcggtccctatgctgagaaatggtttagtaacccagaatcgccagacagtacacgtttttccagccatgcggtctggatattaatcacgaatcccgccgcgctgcaaaaacgcctcacatatattgctgaacatcatccatccgctcaggtattgacctttttccctttcttgccggatgtctatgagaatgcagcggtgatgatgtcaaaactcacggtgtggcagaacacgttttcaacgttatcactgcgatcccccctcccctgcgtatttgctatttatgcgcagttgagtaatgaacgccttagccataattctgataacgcatattggactggaaatattaatcttgcgaaccagcagcctatcgaaattacgcaagccctacagtcactgagccaaagacttgagttacaagatatcaatcactcaggatttgcaactcagcgtaatgttatggcccataatttatttacctggttgaatgaatcgggggtgacaaaccttctgcaatctattttctcgcgcacccccttacggctaacagacgtcattttgtcggataatggcaaagggttcatcaggcatggtgcctggtcagcctggctggagaaaaagtttggcatcataccgagcttagcctcaaccttgtcactgccacctttccctgcggtgatcaatgaccagaagcctgcaataaaaccacgggtgaaaacaccggtgataaaacctatccccgcatcccgtgggtggttatggagtgtgtgcttcgccgcggtgctattagcctcacatatgctaaacaccctgtggcaagaaaaaaaccggcatgcgcaatttaaccaacagatggtgccgttggacaatatcaacgatttttctgctcagtacctggcacgcagcatcacccagttaaccgatgaaggtaaaacattaaccacctgcgttaatacatttgatgtgacacgttgggggctgtctcaatgtcagacgttattaagccaaatcaaccgccggattgaatcctatgaaaatattcctgttttcagttttgcccaaaagctccctctgtttgactcaaacagtaccaagctgaaactgaactcacaaaccaatgaaatgatgatggagttgttatcactggtcgaacagaataaagggaaaaaaatcttaattgttggccattctgataacacgggcagttcctccatgaacatgacactttccgaacagcgtgcgctggcccttcgcgattggttaattaaacgcagtgatatcactgtcgataattttattaccaagggaatgggggcttcagaaccggttgcgaccaatcacacggaagcgggtcgagaacaaaacagacgcgtcgaagtactgatattacccacacaagatagaacaagaatgacggagcctaaacctttatgaatgctataccttcaacctactcaatttttgagggcacatttctaacacccgccccagtgttggatcgatcggtgaatattttaatgttcagagatcccgataatcacgaatataatattattatcaaccgcactttgctggaggaagaggatacttctgaaactttttgtgaaaaagagatggacgcattacgcaataaactgccaggttttcaggttgaaggtaaactcctcaagcatgaaataggtccggctaaactgcccgtagtacaggtcgctaatcactatttgcaagacggtaaaaaattccgtcaagtccaatcaatcatgcagttaccctatcactcgctgacgaataccgatggacgtagtgtgctgattttcaccctgaataccgacggtgagtttactgaatatcaacgcaagcattacgtacaaattatcaacagtttcaatccccatgttgccgttgcaaattaatttttgagcgatatcacgtcatgctaaataacccgacttagcatgacgtggtcgtattggcagaatatgttaaacatcgccctcttcgcaaatgactctggtttcctgtattcaaaaagtgactggcgctactgatacattttgtctgtatcacaggagataaaaatcacaaggtatggggttcatagaggagaatatttgactgggtgtatttgactggggtgtatttgactgatagcgcgcgatacaacagaaacgtgacaataatttcagccgggagaggcggcagtaacgagcctatctacagctcataccgttttggctacatacgataacagccagtttttatcctggccgaggaagtgacatttattaaaggcaaataaaaacagcgtctttattactgtaatttcgcattagtgatgcatacttataaaactctaaccgattgaacatgcccaactttctgatggcatttctacgatgggtcaatatcgttttttcagagcggtcaagtattttcgatatatcggtcgtgctatgccctttcccggtgagttgcacaactttactttccgtcatcgaaagttgtatatagtttttcaaaccaatccttctttgcaggtcacttttcatcatcatattataattcagacgcgcaatattcagaattttcttgattttagagatgacatcataaagccctaactgactgctgttaaatggaatattaaccgtcatcataggtttattattattgctatcgtttttctgtataaaactattttcttggtatatgttaacaatcaccatgagatctttgaatatcacattcgcgttgtttgaagctcttttttcatgagaggggacaatggaataatccatatcatcctcttttataagaactttcttgagcagagagagtaacccgaactcatagaaagcattacgggttttaatcgccacactgaacatatctttacgttccttattttttattcactattttccggtcatttatccttgagcgaagctcaccagagatgaacgctgtagttaaaaatgacactagaataattaatagcattttatctttttaattatcactcggctgctgagtaagaaaaatcggcagaagtgtaataaataaaaagtgaaaactgaaaactgaaaactgaaaactgaaaactgaaaactgaaaaaaagtcatttccattcaaataatggcacataaagctaatggatatggttgagaacaaggtgacccctctcaacgttcacatctcattcatcaacacctcaattcactatcaatacaaaataaaaaacctaacttaacctccgcgatatcaatctagtttagtcaatgtttaagtggcttgattaaacagtaacaagagatagatgtatatgagaatgcaggcgaatattttgtgggattattcttacacagagtgtacgagctttcacaaggatcacatatacccaaaataattcgcggtttagaaagggtgctaaggataaataaattgatcgaaaaacaatttgaacagtatttatgctaacccgcaaagtgaacattggggatgaggctgatgaagcctgataaatttatttattttaaggttaaaaaccagataatcaaaacagcatttccttttttctgtctgtttcaacataatgaaaaatgaccatcaattaggtcgctccatgatgaatgagcgatattttccgctataataagggttaaatcctacgtaaaaataggataaataaatatcgccgtatgatttttctgattttttatggcaataaataggtaaaatagtgtactacataaattaattataaaaattcaactcaacttaagtatagccattattttttaaaagataatcgttataattctcaattaaatatattgataaaaatatcgttcaaaaaaggcaatcgagataatataaaatttaattcaatatgaataatataagcttgtttaaaatttacaaacaaaacaatcacatcataagtaataaccttcagtagcaatcaccgtttaccgctgcgatcatcaaaccaagcaggcttattaaatgagagcacgttcaaatgactgtggctgacttgcggctggcggcgcgcccaccctcagtgcatcctgatgagatttcacatctgatggatgagtaaaaatcgttaagaaaagagggcggcataaccctaatgcggccctctttttcatgctattgggtaatcattgactcccctttgcgcactctgcccacggcttcccctaactgccataccgccatcgcataatgggtactgtggttatagcgggtaatcgtgtagaagttaggcaaaccgtaccaatattgataaccggtacccacatcaaagcgcagcaaactggtctcctgataatcgcctaacggccccttggggctaagccctgctgccgctaaagtcgagattggataacgggtcttaaatccattttcgagatttggagcctgtccattggcaggtacagctaccggcgcacctttcgtccaaccgtgggatttgaagtaattggcaacactgccgatagcatcaacgggatcccataagttgatgtggccgttgccatcaaaatcaaccgcatagcgcttaaatgacgatggcataaattgaccatagcccattgcccccgcataggagccccgcagactgagtgggtctttcccctcagcacgcgccattaataagaaggtttccaactcacccgtaaagaatgttgcacgccgtgggtaagcaaaggacagcgtcgccaaagcatcgatgattcgggttttccccatcacccggccccaacgcgtttcaaccccgatgatcccgacgataatttccggcggcacaccgtacacctcccaggcacgttgcagcgcaccttcatattgattccagaaaaccacaccgttctgcacattatcaggagtaatgaatttattgcgatagcgattccaggcaccgtttggcccggaaggtggtcgggacgtcggcgcttgcttatccatcaaacgaataacccagtccagccgctgggtctgagccaatacatcgtgcagttgctggcgatcaaaaccgtgctcacgcaccattttgtcaacaaaacgcgtggtatctggattaaaggcaaaatcaccgttttgcaactggcccgcatgttccggctcaagtaaaaaaccgccctgaacagggctatctgacggggttgcagcaacaggaggcgtcggctggctactacaagctgagagcaacgtaaacaaaggaagaatgacagccaaataacgcatcgaatacctataaaccatacaaataagtgatagctatggtaagccattgtctgttgtgaacaaacaggaaaatgccgctaaagtcggtactcttcatataatgaaagctaaatatgacttttcaatggctgacgcaatatagggcgcgtttaccgccctatatcccctcacaacattcatcaaaataaacatattagattcaataattaaacatttatataacaatgataatcatttttattaccataattcgtttctttctatacaatcattttgcacttgcctggcaacgtcgttttcttccctgaccttttaaaaggatcgttatatgaaaatacctataccctctattggccatgttgctttactggcgtctgcaatcctgtttgcgagctctgccaatgctgcctcagatgaagatggcattatcatctacaatgcgcagcatgaaagttttgcaaaatcttgggctgaaggtttcaccaaagatacgggtatcaaagtcacgctacgtaatggtaaagacagtgaattgggcaatcaattgattcaggagggcagttcatcgcctgccgatgttttcctaaccgagaactccccggccatggtgttagttgataatgccaaattgtttgctccgctggatgccgcaacgcaagcgcaagttgctaaagaataccggcctgaagatgggcgctggaccggcattgccgctcgcagcacggtatttgtttataatccggcaaaaatcagcgagtcagaactgcctaaatccttaatggacctggcgaaaccagagtggaaaggccgctgggcagcttcaccctccggtgctgacttccaggcgattgtcagtgcgatgcttgcgctaaaaggtgaacaagccaccttagagtggttaaaagccatgaaaaccaatgcgacagcatataaaggcaatagcaccgtgatgaaagccgtgaacgccggccaaattgatggtggcgttatttatcattactatccctttgttgatcaagctaaaaccggtgagaacagcggtaatattaaactgcattacttcaaaaacaaggatcccggtgccttcgtcagtatctctggcgcgggggtattggcttccagcaaacatccgcagcaagcccagaaattcgtacaatgggtcaccggtaaagcggggcaggatttcttgcgcgagagcaatagcgcctttgaatatgcggttggcgtgaatgccgcttccaatcctaaattggtgccactgaaagatttggatccgccgaaagtagaggtgtctaaactgaacagcaaaaaagtggttgagttgatgaccgaagcgggtctgctgtaatccgttttactccgcccctgcgggcgtttaacaaaccgagtgtctttaccgattatgtccaatataagtaccgatgttgcacaggctgcactgagtaagacaacagcacgacaatctagtcaccgtccgggtacaggggtggttgttattgcaataatactgtcgctgttatccctgctaccactgggttttgttatcggtattgcaattgatacaggttggtcaacggttaaggcactcgtttttcgccctcgcgtgggcgaattactgatcaataccgttttactggtggttttcaccttacccctttgcgccacgattggcgttgcattagcctggctgacagaacgcactgccctgcctggcaggcggctttggtcacttctggcaatagcaccactggcagtgcctgcttttgtacaaagttatgcctggatcagtctgatcccctcaatgaatgggctggccgccggcgtttttatctcggtgatagcgtattttccgttcatctatttgcctgtagcggcggtattacgccgtcttgaccctgggcttgaagatgccgccgcatcattgggcaataaacccatcacggtatttttccgcgtgacattgccacagctaaaattagcgctatgggggggatcattacttatcgccctgcatttactggctgaatatggcctgtatgccatgatccgttttgatacctttacgaccgcaatttttgaccagttccaatccacatttaatggccccgccgctaacatgctagcgggggtattggccttatgttgtttggggttactgttggtcgaagccaccagccggggctaccatcgctacgcgcgggtcggttccggtacgccacggcgtcaaaccgtctattcgatggggacctcactcaccctcctgtgtctgctattgcccttattgatcaccaccctctccttgggcgttccgttcattacccttgtgcgctggctctttattggtggcattgatatctggctgaacccggaactgctgcccgcgttaaaacagacgctgggattagccctgagcggtgcggtgatcattacgctgtgtgctataccaatggcctggctatcggtgcgctatccggggcggttacaccgcgcgatggaagggtgttattacgtcaccagttcgctacccgggatcgtcgtggcactggcattagtgaccatcactatccgtattgcacgccctttgtatcaaactgaatttaccgtgctactggcgtatttattgatgtttacgccacgtgcattaatcagtttacgggcgggtattgcacaagcgccggtcgagttagagaacgtcgcccgtagccttgggcgaacaccgacccaagctatgttaagtaccaccctgcggttggctgctcccggcgccgctgcgggtgccgcattagtctttctggctatctccaacgaattgaccgcaacgctattactggccccgaacggcacccgaacactggcaacagggttttgggcattgaccagtgaaattgattatgtcgccgccgcaccgtacgccttcctgatggtggcgctttccctgccgttaacctggcttctctactctcaatctcaacggacagcaggactatgagcacgcttgaacttcatcatatcggtaagtcttatcaatctgtcatggtactggaccgaattgatttacatgtcccgccaggtagccgcaccgccattgtcgggccatcggggtcaggcaaaacgacactgttgcggatcattgccggttttgaaacaccggatgcgggcaaagtgatcttgcaagggaaggcgatgttcgatggcacaacctacgtccctgcccacaaacgaggcattggttttgtaccgcaagatggggcgctctttccgcatttcacggttgctggaaatattggttacggattgaaaggcagtcagcgggataaagagcgccgaattaatgagttgatggatatggttgcgctggatcggcggttatctgcactgtggccacatgagatttcaggtgggcagcagcagcgggtggcccttgccagagcactggcccagcgccctgtgctgatgctactggacgaaccgttttcagcattggataccgcgttaagagcctcaacccgcaaagccgtggctgagctattgtcagaagccaatattgcctcaattctggttacccatgatcaaaccgaagcattgtcttttgccgaccaggttgccgtgatgcgagcagggaaattagcccatgtcggcccgccacaagagctttacttacggccagtggatgagcccaccgccacgtttctgggagagacgctgatgctcaccgctcagctaggtaccgggctggcacactgtgcacttggtcaggtaaaagtggataacccacatcgccgtggtgaggctcgtattatgttgcggccagaacagatcaccctcaccccgctacggcctgaacaatataacgccgcatcctgcctagcaaaggttgtagccattgattttgccggttttatttcgacactcaccctgcaaatcattagcagtggggaaaccatagaaatcaaaacgattagccgagaagatctccatgtcggcttaacagttggcctggatatcatgggccaggcacatatttttgccgagtagccgcacttaatgttgccctgacaaacggcgcgtcgccataaccagagcggagcctcagttcttggaacccgtttagctctcagaacaggttttttccccatggcgtaaccgccggtattcaagcagtgtcagggcaataacaaacacatccaggatggttatcaggatcaaaagcagagaatgagtaaaagtataacgatagagttgataaacaataaacagactaaaaaccgccacagcaacagggtaataaccgagttttttacgccacaacccaataataatccataacttaatggcaccgtggataaacaaatatgacgcagcgaaatgtaagctactaatggagagatgttgggccgcatgcaacagataattggcaataatgtcaccacggctttcaataaaactcacttgtgtgatgcgatgcagcgtattcagtaaaaactgtggtgtcacaaagtaggttaagacccctgcgataatctccatcatggccaacgaggctttcaacagcaggctcagttcaaaaacagcatgaacgtttttttcaccaaaaagatttttgctactaaatcgatttttcatcttcaacatcgcacctggtttcctacgtggtcatactgaggacagcttcaacagaggatagctttaacagaggatagaataaccgctcgcctggtgccgattaaagcgccactttatacgaaacagggttgtcgttcttggtattttgctactgccagcgatatttttctcccgccagcgataacgctccgtcagataatagtagcggataatctaatttactcccccttattttttagtatattataagaaatgaaccacattaaattatgttttgttttaaaaaaaacaaaacactcaccattataattttaatattttaccctaagtcattcgagttgcaggaaggcgacaactgagcaaatccccaggatcgtatttattttaaggtcaacggcactaaatgactgggatgagcaagggcaactccccccctgcatcttgaaggccgacgggtatataaggacatatgagaatggctaacatgatttatttaacactcaagggcaaaaaacaggggttaatttcgtctgggtgctcatcaattgactcaataggcaataaaagccaaggcagtcacatagatcagatctttgtgctcagccttaatcacgccatgacccgagagcaaaacgtcagccaccaccccatttcttttataaaacctatcgataaatcatcccccttattaggggtagccatatcagaaaatgaattgcttgatgccgtttttgacttttatagaacaaacagcgctggtgctttagaactttactatacaatatccattaccggcgcgacaatttcagacatatcaacttcacacagccattcaatcacacacaatggctcccaaccacaagaaaccatctctcttaaatacaaaagcattacatggaatcacaatgtagcaggaaccagtggttatagcatatgggatgatcgcgtgtattaatttattcggggatggcctacgccatcccttattatttacgtgtacatacgccttgcggcaatataaggaatggcacttaaataacctaatatcaatgacatatagatgattagtttctgacatctatatcctcagggggtgaatataaacatttaatttttaaacaataatatttatcataagaaaaagaaattcagccacattaaaaatagagtgtgacgaataaccattaataacttctcgcttgaacatttatagcagtataaccaccaaaaaactcagccaacagacccattgaactcatatttttaatgtccatcgattttagtccccagagaagatctgcatttacataacgatataacctcgtggcatcttccgctaatttataactcattattccatttattgataacgcaacatcgacagcagtatacataacagctgaatcactcttgctcaacccaaattgagcgcccacaccttcataaacaaatttaactgggccagtatatgattctctatataaaatataatacccactttcaactatgttattcgcaccatgaagaatcaatagtgtaccagggatcgaacctacaacacttccaaccatcccaacaccagcaacaatttgtaaacctgcggtaacaaatccaacgccagcaaatactaaatttataacttcgtttctttctacattattatttttctttactgaggctttaataatgacagcctgctttactctttcccttgtcatttcttcatcttgatttctcaaatcggacaactctttatccaatagttttatcgctgtctcagtcgttatttcaccagtatttactttggccgttatatccgatgaataacgtgtcacctcactgataaattgatcctttataaggctccatttgataaatttacttgcaatgctattttttacttgatccagttcattctgtttattgtacataatagaacgcataacattatttcgttgacgcgtcttatcttcgctattgatgtatggatttctttctacagcatctaacacttcttgcaatgagtgtcccattatttattcggttccgaccaaaaaattattttccattatctcttttttaaatgaatttgggggggaatactaccaccaactgattttttcagatatttctttattaccacggtattttgttattactacattttttcattaccacatacagtactaaccccattgggtggtcgtgggctctctcctccgtgccctttcatgtacttgatgtgtcagagtgccataccgcaatattcggttgccagtgatagccgcaaaaatctgacatgccattcttacgacaaacagccttcacctatcggccaccttcaaactcgggcaaaccagtgaggtctgagtttcaatgcatgtgctttcttcatcatggctctgctgtgtgatatgactcaatagaaaggggctacgacctaatgaaacagaaaaaataatctgagataaatatgatttaatcaaaaaattgagacttttctcaagaaagtgaagtagattaaataaaaagacaaagtcacaccaataaaaaacacccaattttatttgagattgattctttattacctatttaccccacaaatacagatcaattaaatgtataaggaatagttaatttgtcgtagcggacaacgtataaacctcgccactttcgcataaatcaccattatatttttgttatacggtcttaattgatttacatcatataaaagtaacaacttatttcctaaggtggagcattccagttctatacccaagtcattggcattgttgctaacaccacgacaacgtcaagtaaaaaagggatgtcctgctcttttatttccgcaaggataatgttgatgaataacaataaaacaccgctcaccggctcactgagtcgtcgtgaatttattcaaacatccgccgtagtgaccggggctgcggcaattgccggttcaatcgccctcccattctccgtccatgctgcggcttcagaacatgcccccacggcggctgaagagagcattaaatacagtgcttgtctggttaactgtggcagccgctgtccgctaaaagttcatgttaaaaatggtgaaataattaaaattgctaatgaagccatttatgatgattccacctttggcttacaccaaattcgcccctgcttacgtggccgttcagtacgatggaaaacctataatccggatcgggttaaatatccgatgttgcgagtgggtaaacgcggtgaaggtaaattcaagcgtatcagttgggatgaagccacaactatagttgcggataatctgaaaaaaacgattgttcaatacggcaacgaagcgatttattatcaatatggctctggttcaactggggctaatttacaaggccgcaatgcctgtaaacgtatgctgagtttgatcggcggttatcttgatcagcacggcacttattctaccgcccaaatcaataccgtcatgccttatgtctacggcaacttagatgaaacactactggacgaaattaaaaattctgatctggtggtgatgtttggtcacaatctggcagaaacacggatgtcaggcggtgggcaatatattgaaacggttcaggcgttgggtcaaagccgagccaaagtcattattattgacccacgcatgaccgacagtgtgaccacccttaacgccgaatggatcccgatattcccagggaccgatgcggcactggtcgccgcgctggggcatgttttaattaaagagaatctgactgacgaacgtttcctgcaacaatattgtgtcggttgggatgccaccacattgcccgcatcggccccagctaacggatcgtataaagattatattttaggtctgggtgctgacgaaaccgaaaaaacaccagaatgggccagtgagataaccggtatttcaccaacacgtattattcaattagccagagaactgggtaatgcccgcgcagcctggatttcacagggttggggaattcaacgcacagcgaacggggagcaagcgtcccgctcgattatgatgctcccattaatgaccggtaatattggccgtgccggaaccaataccggtgcctggggtggcaacgtaaaatacccggttcccggattcagcattcccaatccagtcaaaacggccattccttgctttatgtggaccgatgctattttccgcggcactgaaatgaccgctaaaaatgcccatgtgaaaaataaagaaaaactggataccaatattaagtttctctggaactacgccagtaacgttatagcaaatcagcactctgatctgaataaaaccaatactattttgcaagatgagtcattgtgcgaatttattttggtctgggaaaaccatatgaccaattcggcgaaatacgcggatttattattgccagacgtcacgtcggttgaatcaaatgacctgattgataactcctatgccagtggcgcttatcactatgtcacccggatgcaaaataccattgagccgctgtgggaatgccgcccctcatacgatgtattagccgagattgccaccaaattaggcgtgggggatgcctttactgaaggacatacccagcaagaatggattgaaatcagctataacaaaatgcgtgataaaaatccggcgctgccgcctttcagtgacacccataacaaaggcattattgaccgtatttttgctgacagtagccaatatatcgcgttaaaagatttccgcgatgatccagtaaataacccgttaaaaaccccatcaggcaagattgagatctattccgaagcactggcaacactcgcactcgagtggcagctggcgccgggtgatcgcattaccgcagtggctgaatattgtccgacccctgagggcgtcagtgatcaggaaaccctgaagagctaccctctgcaaatgaccggtttccatgttaaaggccatacccactcaacctattacaatgtcgcgatgctgcgcgaagcggtgcctcatcaattctggatgaacccgattgatgcacaggcgcgtggcatacagcaaggcgagcgggtcgaaatatttaatagccgtggccgtatccatattgcggtcaaaattactgagcgggtattaccgggggttattgctgtgccacaaggggcatggcgtaatctcaacaaggacggtatcgacgtgggtggctgtatcaatacgttgacgacacaacgcccttcgccattggcgaaaggtaatcctcaacacaccaacctcgttgaagtaaaacgtgcataaggagctgaataatgaagcaatatggtttttttgttgactccaccaagtgcacggggtgtaaaacctgccaagtcagttgtaaggacgaaaagaatctggaccttgggccgaaactgcgtcgggtctatgaatacggaggaggcagttggacccaacaggacaatatctgggtacaaaatgtcttcagttattatctgtccattgcctgtaaccactgttcgtcacccacctgtgtgacaggctgcccaacgggtgccatgcacaaacgtgaagaagacggtttggtggtggttaatcaggatctgtgtgtcgggtgccgctattgcgaaatgcgctgcccttacggtgcgccacaatttgatgccaaaaaacagctaatgaccaagtgtgatggctgctacgaacgcgtggctcaaggggataagcccgtctgcgtcgattcttgcccacaacgcgcgttggatttcgatgaaatctcggtgttacgtgataaatacggtgacgaaaatgcaattgcaccgttaccccatgcgcatctgacacagcctaatctcgtgattcgtggccaccgcgatgcgaaaccatccggtgatacatcaggccgcatccaaaacccggcggaggtataaaatgcatgaattacctttagtattttttaccgtgctcgggcagaccgccgtcgggctgtttacactggtgtggctcagtaacaagctagggatgaccacgccgctgcaactgaagcaggccaatattgttgggctgattctggtgatggccggcctgttaattggcaccctgcatgttgggcaacctctgcgggcgataaatatgttactgggtgttggccgttcgccaatgagtaatgaaattctgctcagtggcctgtttgttgccatggcttgcggcacggtattcttttcgactctggtgaaaaattcgctactggcggcgctgtgtaattttgccactgttctggttggtctgacttttgcttggtcaataactcaagtctatcaactgaccacggtccctaattgggatacgtcatatacctcattgcaactttggatgacggtattggttggcggtggggctttcgctatgttaaccggggcgcgtcaacttggtgccatagcattgctagccggtgccattgtgaccttggtgaataaaccgggttatttaactttcctcgggcaaggctcggcggaattgagtagccagcagaccctcttctggggaattcagatcctgctgttggtattaggcgtttttgtggccgctgcggcgttactgaaagacaaaatcccacgggcaacactggcagtgtgtgcatcagcgcttatcatcggtgaattagccgggcggattgccttttataatctctggcaaataccaatgtgatttaatgcgttgatttatcattccatgtggtgatttacccgctgattagcggctatttttgcggctaatcagcccccgaataacgttatatcctaaataatttacgtggcaggaaggcggcaattgagtgaatccccaggagcttacaccggtaagtgactggggtgagtgaaggcggccaacgcatctgcagcttgaaatatgacggatatcaccctaaatagttcaagtggcaggaaggcggcaattgagtgaatccccaggagcttacaccggtaagtgactggggtgaatgaaggcggccaacgcatctgcagcttgaaatatgacggatatcaccctaaatagttcaagtggcaggaaggcggcaattgagcgaatccccaggagcttacaccggtaagtgactggggtgagtgaaggcggccaacgcatctgcagcttgaaatatgacgggtattacataagagcgataaccccgatgctactcaataccaccttgccacggattttaggcgcgtgtttttattatccaccgcaatcagatacggtacagcgcctctttccgttattgccacacattgctgagcttttcccttggcccgatcacgcgagcatggtgcaatattgccagcaaataccggatatctcccccgaacgactggagtacgatttttcgattctgtttgaagggcaaggtgcgatgcctgccccgccttggggttccgtttatctggataaagaaaatattttgatgggtgccagcaccttgcaataccgtgaatttttagccgaacaggggtgggttagccaaagccctctgcgtgaaccggaagatcagtttggcttaatgttattagcatgggtaaatttgatcgaacaacataataaggacgcagctagcgtgctgctaacggtgcatttactgccgtgggcgtaccgttatcttgaacaggtcaacgcagcccaagtcgaatacccggtttatcccttactggccaaaatagcggcttgctacctgaaaaccttgcaaacagagttggtgttatctcctctgccccgtgagctatatcggtgacaaaaaataaatcagtggctagagacgaacgttactataaagcttatctggaaagccggactatcagccgccgggggctatttcgtggcttgctgaaaggcgtgcagcccagcaccacaaccgcgccctctgacatcaccgcccctcctcccctccggccgccatatgctattgacgagccacattttcaacagagctgtaccgggtgcggtgtctgtgtggcggcctgcgaggaaaatctgattgtgatggtcaatcaaaggcctgcgttaaatttctcgacgccctatttctcgacaccctattgtagccgctgtcaggcttgcagcaccgcctgccaaacaggcgcattatcatcagccgagttccatattgccgcccgaccatcagtaaaaaacatctgtcaaaatacctatatttactgtgatagctgcgccgattattgtgagaagcaggccctgatctggcaagccaaccaaccgcccacactggttactgagctatgtgatggctgtggtgaatgcgttttcaggtgcccagcaaggatattagagatgcagatatagcgggtaattacatcaataaaaaactgcaccttattcagttgggtatccaacttttggggtgcagcccagtgattgaggtatgagattgatgacaaagcgatttatagcgcggtgagtggagggttgaacgcacctagatcaagatataagggcgttcagttagcttacgccgcgacgcccccaacggtacgtttccccttcagttgactttgtcagcagcctgaaggggcatctatcaataatacttatttcccatctttaccgtattgcggtgaacgagggccatacagaagcccattaggcgtccctgcagaaagcattctggcgctggttataccggcaacatcatggcttttatctgtgatggtattggcaatctgactgaccgcagcctgcactaatagaccgataacaccgccagaagagttattcccctcattgctggatgcggttgcactgccactccacagcagcttaccggttttcaaatcaaccaatttcgcattagcggttacgcgggtatcgctggtgatgacctgataagaggtaccgtattgcacgatagtgatgtacagcaccgcatctgcaccaaagatttggcgcaacttggcggggctggccgcactaatatcacccgcgttggtcatgccattttgtttaaatgtttcttcaaccacggccaccggtaacacatagtagcccgcttcagccaacggataagtgacttgagacagtacgccatggctggcgtccacttctggcgactgattttgtggcaacagcaccaaaatgcttttgggtttactttgcttaaagtcagtgtaatccgtcgcgactggcgtggcgcacccagtcagtagcaacgccatcatgacagcacatacggcgaaaatagatttcatttaaatgcccctttatccttgctcattaagaaatccataaacggagcagactcagggaaagtggctttctccgtgttaaattcagccatggctaattccggatgaccggtgttggcatacagcatccccagatgcgcgtgcaagccaggggggactggcaaacctttagcttgtgacttctcaatattttctttcagtgccgcaatttgctgctcaggcgtttcattcgatttgtaatattcataaatcgttgactgataattatcccaattataaataggcttaggtgcagtcacgcagcccgctaaaacggcgacggccagcaacaacgatattttcttcagtaatttcatcttgcagtatccatactcattaaggtttattgcgcgggttgccatgcaccagattcaatacctgcgaccaagttgttcacggcttcacgaattgctaaatccagcactttgccattcagcgtcgaatcgtaactggcagtaccaccaaaaccgatcacttcacggttagacagttcgtactcacccgccccctgtgaagagaacaccacttcggaggtattaacattaacgatattcagattgaccttggcataagccacctgagatttaccacgacccaaaatgccccacagttgacgatccccggtttctttgcggccaaactcagtcacgtcacccgtcaccacgtaggtggcaccttttagttgctggcttttccctgaaatagcggcttcgtttttaagttcttccatattggtacgctctaacacgttaaagcgccccgtttgttgcaaatgtgtcaccagaatggttttggattgattccccaagcggtctaccccatcggagaacaacccactcatatagctggagcgattatcaaacttaccgacagaaatagggctacgtgggccattatattgggtgccataagaggcgacctttgccacttcaagggaacgtgatgattcggtagcacacccacttaataataaggcgaccataaatgtggtgcttaaaaatatttttctcttcataaaaaggatattctcaataaaatttaaaaattattgccgtataaataatgaataatggcaatttaacttaagctggaatgatgttccgacttaaggaagcaaaaacaaattaaatctatatacccaaaataattcgagttgcaggaaggcggcaactaagcaaatccccaagagcttactgtagtaagtgactggagtgaacgaaggtaaccaacacatataccgtttgaagaatgacgggtatacgttactgacagtaaatcatagtgtttgcttgattgcacaggtcgtaccgaaaggataataacagatatcaattctatttaaaaatgtttcatgaaaaagttttcgatacttagtttaataactaaagaattatcttatggatttaaaattaaatcattggccttatttcttatataaatttagtttaattatttatagatttattaccttttttcgtaagtataaaaactaatcaccattattgataccgataaaaaatctattagttgctataaccataatattgattactacacaaacaatacggctgaaaataagtacagcccattgccatgatggctcactacaccataaggtcaagaaaaaaggggattacctggcggataccagtacaatacggataccttccgtcctcattgcactcacaggagtgaacgccgtgttcagttaccccgccagttataccgttgatgaagccagtggcgaataccatattcattatcgtgacttccctgaattgaattcagtgacctactcccttgaagatgtcgagttggaagcacaggaggggattaaaaacggcattgctaccgagatggaagagcgccgtctgatccccgccccctcagcactgcagccgggtgatatcgcagttcatgtccctattcttgtgcgcctgaaagctgaattacacaatgctatgctcgccagtgatacccgcaaagctgatatggcccgcaagctcagtttgaatgccgcccaaatggatcgcctactggatgtttattacgcttctaaagtagaagcactggaacaggccctttatttattgggctttgaagctgatgtcagcgtgcggaaaatcgtctgattgacttactgacgatgctctccgccgctggcccccagtcatcaacatcaacctcggagcgcatcaacgccctttgtcatcgccgatcctgggatcattttccaggcatcattctgcgcaaagtatcatcgcggcgaatatagtgatgatacagtgccgcaacaccgtgtatcccaatcacgaaatagcctaaattggcaatgaacacatgggtttgcttaagataatcccgcacgtcagtgttaggcgtgagccactgcggtacttgccagcccagcagtaaccaagttcttccaccataagcctgagtcaaaaacccgagaatcggcagtgataggaacatcagatacaacccccaatgcgaaatacggacacccaataactgccaatgaggcaacggtggcgaaatggctggcgtcgggtttctctgccgcagccaaagccgcactaacattaatagccagacagaaataccaaaattaaaatgcaggtttctcacgaatgttcgctcttcatcgggcaccgtatcgctgagcaacatggccaaataggtcaagatgatcatcaataaagttaaccaatgcagaactatttggggtaaagagtagcgatttttcataaccatgctccgttgacggcataagaataatttaatcaatatgacgcaaatcgatgaaaacaacatgaagaacatggcaataatagcgcacagagcgatttgctattatggcgatagagttgcattttggtgatagagttgcattttagtgatagagctgcattttggtgatagagctgcattttggcaaaacacctaagcgccttaccaaaatgtaagttactggctaatcgactttgtttgattaggccatttcattgggggaagatttgcccggtttcagtaaaccatcagcacgaaacatgctcttaatcccacgtaccgcctgacgaatacggtcctgattttcaattaaggcaaaacgcacatgcgtgtcaccgtagtcaccaaagccaatccccggcgagacacacaccttcgcctctgccagcaagcgtttagcgaactccagcgaacctaaatgtgcataaggctctgggatttttgcccagacatacattgaggctttgggattatcaaccatccagccggcctcatgtagcccacgcactaaggcattacgtcgctggcggtattgctcagcaatatcacggacacattgctgatcgccttccaatgctgcaatcgcggctacctgtaatggcgtgaacgtgccgtaatcgtgataactcttaattcgggccagggcactgaccaattcaggattgccgaccataaaaccaatccgccaaccagccatattgtaacttttggatagcgtgaagaattctaccgcaatatccttcgcgcccggcacctgcataattgacggcgctttccagccatcataaacgatgtctgcataagccagatcatgcaccaccagcacatcgtattgcttcgccagcgcgacgactcgttcaaaaaaatccaactcaacacattgcgctgttgggttggatggaaaaccgaggatcatcattttgggtttaggaatggtttcacggatagcgcgttccagctcgccaaaaaaatcaatgccttcggtcaacggcactgaacgcacttgcgcaccggcgatcacggcaccataaatgtgaatcgggtagctggggtttggcaccagtaccgtatccccgtgatccagcgttgccagcatcaggtgagccagcccttctttagagccgatagtgacgatagcttcattttcgggatcgatatccacctgatagcgatcggcataccaacgggaaatcgctctacgcaggcgcggtattccccgcgaagttgaataaccgtgagtatcttcacgttgcgcgacactgcacattttctcaacgatatgcggcggtgtcgggccgtcaggattgcccatactgaagtcaataatatcttcgccccgacgccgggcagccatctttagctcagaagtaatattaaaaacatacggggggagacgatcaatacgggtaaaacgacgtttagcaggtaattcagccataaattcctcgaggatacgtgagcgcccggaccgtccgagcgacgctgaccatcagatggtctgtttatgaacatatcctagcgctgaataagtgtcgagtgattgataacaaattttttacgtcttaaaaaagaggaaatttcagcctaacctcatccctttattcttctctattttgactgaataatattcacgttaacataacaaaaaatatacaaatatcctgttaagtcccaacccctacagctctcggagaatcaatattatggcttcattacacatagacgatatccctgcggccattaaagcggtcaaacaacaattacgccaggcgctccctgactatcaacaagtctttcaagccgttgaagagaatatccgccagcaagtcatggagatccgtcgtaatctggccgaaggtaaaaacccggtcccacaactccatgccgatgatattatcaacggtaaggtgactgaagaacaaaaagcgcaaataaaacaacgcggctgttgtgccattctcggggtatttccgcaggaaaaagccaccgcatggaaccgtgaaattggcgactatctggatcgtaacaactttgtcgaacgcttgaaaaatgcggccgaagacaattattttggcacgctggcggccagtaaacctcagatttatggcatttactggtcaacgccacaggtcgaagcccgtcaggataagcgcatgcaggcagtgcaaatattcttaaataacctgtggcaaaccgaaagcaacggtaagcaacattttgatgctaaccgtgtcgtcacctatgctgaccgcacacgccgccgcccaccaaaatcctcttcactcggcctctctcctcatgtggatggcggttcgattgaacgctggctggatgagaatttccgccatgtttaccgccatgtgttctccggtcaatggcaaaaatatgatcctttcgccgctgagggccgcccggaagtccgtgaattcccctcaccggcggtgtgttcgatgttccgcaccttccagggatggaccgcactgaccccacagcggacccatgccggaaccttaaatgttattccgattgctaatgcaatggcttacatattactgcgggccttacaggacgatgtcgctgacgacgatttgtgtggcgctgcacccggccgtgcgttatcagcttctgaacagtggcatcctcttttaatggaagctatttcccctattccagatttagaggcgggtgatacggtcttttggcactgtgatgtgatccattcagtagagaatgaacataatggtgagtttgatagtaacgtgatgtatatcgctgcagcgccgtggtgtgaaaaaaatgcggcctatttgccccgccagttagccagctttattgatggccgttcaccaccagactttgccgcggatgatttcgaggtggactttattggcagagccaccatcaaaaacctcactgagataggtaaacagcagttgggcataatagactagccttcttccgcatcatatctgccggaacttatcctcccggcagatattcttctgcgcccacgataaagacaattcggttagcttgacaactcataccccaatttttggcgtaaataggcaccagcccccagtaaaccgggttgtggatgagtaatcatatacaccggaatatcttgtaagaaatctttaaaacggcctttatcttcaaacgcagcgcgaaaaccagaggctttaaagaactccataaagcgcggcacgatgccccccgcaatataaacgccaccaaacgtactgaggttaagggctaaattgcccccaaagcggcccataattacgcaaaatagtgataatgcccggcgacaatcggtacagctatccgccagcgcacgtgcggtaatatctttcggtgccagtttctctggtaggcgcgcatcagaaatcacaattgcccgatataaattgactaagcccggcccagatagcacccgctcagcggaaacatgccccaactcctggcgcaatacggccagaatctggtcttcttcttcactattaggcgcgaaatcaacatgcccgccctctcccgctaaactaatccaacggcgatcaacattcactaaatgtgctacccccagcccagtacctgcgccatacactgccaccggtttgccaggctgtggctgtgtgccaccaaattgcagaacatcttgggcaggtaacacggggatagccatggagactgcggtgaagtcattgatcacttccaaatggtccagacccagattctgttgcatggcggcaatagaaaatgcccaagtatgattggtcattgcgacccaatccccggtaatcgggcaggcaatcgcgatacaagcatcggtgaccttggcttgatgctctgatagatattgtttgattacatcctctaaactttcatattccaaccctgaatatgtctttgcttgcaatatctcgcccgttgcaacagcgcaaagcgccaaccgggcattcgtaccgccaacgtcacccaccagggcataagtcgtcatcaaaatctctccattgcaagatgcttaacgtcaattatgcccactgtaaaatcacgccagacaaacaacaatctcaatacagtaaaccactttgttttgtgactgacatctcataaaaacgtttcagccgtaatcaatcaacacgattgagcagagtaaaaataggcgtaaataaaaaatttagcgtgaaccacgccgattttctgaggcgggtttcaattcagttgcctggcgggagcgaataatccgcatccgcaaactgtcatacatccagttataaaacatcgtatagggcaggaagaacaggaagaaaccgatctcgagcactaacgcatgccatattgagatccctaacgcaaaggcagcaacgggtaagcccatcagaataaagccaccttcaaatcccagcgcgtggaatacccgtatcttgagcgttcttatcacccgactgacgggccaaaaatagtcaaacaggctgttgtaaacaatgttccacaacattgcgattgacgagagaagcaccgccagtgtccccatttgtaatattgaacgatctaatagccatgccccgaccggcgcacaaatagcgacggcaatcacctcaaagccaattgcatggataacccgttcaaccaaagatctgtgatggacttgcataaaacacctacttaaataagttaatagcacattgttgcaggtgattatcatcgctttttaagatagattaaaaatagaatccatcgataaagtagatacgtcatgcattattcccctgaggcattgattgcttttgttgaagccgcggcccttggatctttctcagccgccgcccgtaagctgcgtaaaagccaatcaaccatcagcactgctatcgccaatctggaagcggaccttggcttaaccctatttgaccgacaagcccgtcagccagtgttaaccgatcacggtcgccgtgtgttggctcacgtacaagagattttggccgccagtgagcgcctgactgatttatctattcgtctggcgggtcaagttgagacgcgattaacattcgttctatctgatacctattatcagccagcacatcatgaaaatctgctacgccgctttgagcagcgctaccctgatgtcgaattcgaatgtctggttgccgaagatgaagatgtcattgacctcttgcaactcaaacgcgcccatatcggtgtagtggaaatgcaagaacgctatcccccggatattgcggccactcggctggccgcacagactgaaatggcggtgtttgtgctacgcggtcatcctctgaccagacttcctcacctgcaaaatgagcaactggccaccacacgtcagctgtgtctgaacacctataaccgcactgatcataatcaatctcaaggtttgacatggtccgcccccagctatttgatgttgctagagatggctgagcaaggctttggctgggcgatcttaccccgttggctggtagaacaattcgggcgtgaaaaactggtgactttgccggtgcaaggctggccaaaaatgatctccattgatgcggtttggtcgaaaaaaagcccaccggggcctgctggctattggctattagatcaattaacggaaggcactaactcaccacactgatgacgataacgcgctgattagcactgtgatcgccacaacttacacaaccgatgaaaacgcatacactacaatagcgcttatttttattattgctgctatcgctaatgccgttcgctatcactaatagaggccatcatggtttatcaagcaagttcctctcgctatcaggagatggagtatcatcgttgtggtcgcagtgggttaaagctcccggccatttctctcggtctttggcataactttggtgacagcacacggtatgaaaatagccgtagcctgattcaccgagcgtttgatcatggcatcacccactttgatttagctaataattatgggcctccccccggctccgcagagctgaattttggccgcatcctacagcaagacctgcgcccttatcgtgatgaactgattatcgcctccaaagccggctataccatgtggcccggcccttacggtgactgggggtcgaagaaatatctggttgccagtatcaatcaaagcctgcaacgcatggggttggattatgtcgatatcttctatcaccaccgtcctgatcccaatacgccgctggaagaaaccatggcagcattggacctactggtgcgtcagggcaaagcgctgtatatcggtttgtccaattatcctgcagatcaagcacagcttgcctgtgaaattttgcgtgcactcggtaccccctgcctgattcatcagccaaaatattcgatgtttgaacgcgggattgaagcaggcttacaagatacgctggatgaatatggtgtcggctctattgccttttctccgttggctggcggtttattaactgatcgctatctggcgggtatcccagaagactcacgtgcagccagtgacagtaaattccttagccctgaacaactcacccctgaaaaactggtcaaaatacgccaattgaatgagttggccctcgatcgtggacaaaaattatcacagatgtctttagcctgggtgttgcgtggcgggagagtcacatcggcactgattggtgccagcaaagtcagccagattgatgatgctatcggcatgttagccaatacaaacttcagtgataaagaaatcaacgctatcgaacatattttagcctagacactttcctatcaagcttatcgctagggcacttcaggtgccctctgactgttggctatcgcccatacagataaatcttaaaactttattttacagctttatccgaacgtcaatcttcaatgcactgtttaagatgacctcatgccaataaggccgagcaaggataagagatgttaaatacgggtgtttttaaaccaacaatattaaaaccaatgatgttaaaaccgttattattggtcacgatactcgcctggttaccgttaaccccgatggcgaatgcggaaagcattgaattgttacccagtatttctttgcaaattggtgaacaagatcgtcgtggtaattattgggatggctatgattggcgcgatcgccaatggtggctgaaccatcaaggacgaaatttaggtgaacgtaaccgcaatgggcattactgggatggccgccgctggcaagacaggggatggtggaagaaaaattattactaccgtgaaggccgttactggaaatacgacaagcatggcaataagcatggtcaaaaacatcacaacaaaaaagggcgaggtcatcgtcatgatgactaaatagacattgtcatcgctcaataaagcctgtcaggcgggttttcatggaattattatcggatcgacacgcctgacaacgttcattattaagtctaaagcaggctaatcagtaaataggcatttaacccaaccacgatcagaaccaccaatttacctaaaatctgggtggtttttgtatcaaccagctcccccatcaactctttattaccggtgaaaaccaataatggcaccagtgccagtgcaataccaaaactcagtaaaacctgactcatcaccaatatctgtgtcgcatccatcccagctaaaataacaataaaagaaggcaacatagtgactatacggcgcacccacattggaatataaaaccgcacaaaaccctgcatgaccacttgccccgccagcgtacccacgaccgttgatgaaagcccggcggcgattaagctcaaaccaaaaacagtggccgcagcattacccaacagcggctgcaaggttatataagcctcttcgatttcagcaatgttctcataaccattgaaatgaaaagccgcagcggcggttgccatcatcgccaaattaacaaagcccgcaatcgtcatggcaatcgctacatcaaacttggtcgaggcatagcgctcagttttagactcttcccccccggtttgtgttaatgctgaatgcaggtaaatcacatgcggcataatagtcgcccccaacacccccgcagctaaaaatacggcgttaccatcaggtaaatttgggatcagcatcccacggccaagagccgcaatatctggctgagagaagatcagttcaacaatataagccgcggcgacaaacaatagcagcccaccaatcaccaattcgagaggcttttgccccctattttgcaacataagaataagaaaggtggcaataccggtcagcaccgccccttgcagtagcgtcacaccaaacagcaatttaaagccaatagccgccccgataaactcagccaaatcggtcgccatcacgataatttcggcttgcacccagtaggcccataccactggacgagggaaacggtcccggatatgctcagccaaatttttaccggtagcgatacccagcttggcggacagcaactggactaacatcgccatgacgttggcccacacgacaacccatagcaaggtatagccaaacgtggcccccgcctgaatattagttgcgaaattgccgggatcaatataagcaatggcagcaataaaagcaggccccatcaaggagagtttaatcttccttaatgggcgacgagatgtatcgacagcacggccattaagcatgtcagacttacccccttggaaagtgcacggttattatttacccctactatcttttaaatgagaataattatcaagcgcatttgtgataatggaattatcttttttgttagtagatgccgaatgaatggcgggactgaataacttgccgctcgtgatcgttactgactgattttatgaagaattatgttaattgccacatcgctattttcagaacggatgattagaatcatttataactaccatcatttataactacaatcatttataaattacatgggtatactacttaccatacagattattaacataattttttatgtgatcaagcccactaatttgtttgcatttatgaaagtgaatttttatatttgtggttcacatctcttttttaatgtagccgttacataaaatgaccaccaaaatctcgcctgcctcaaatttggagcacatatgtcccatattctacagtttgcgttagccctcgttgtggtagctatactggctttggcaatctgtaaagatcgtaaaagcatccgtattcgatttgttattcaattgttggttatagaagtgttgctggcatacttcttcctccattcggaagctggactgggttttgtgaaaggattcgcagggtttttcgacacattgctaggatttgcagccgccggtaccgattttgtctttaatgatatgggtgataaaggtctcgcgttcttcttcctaagagtgttgtgtcctattgtctttatttctgcattaatcggtattttgcaatacatcaaagttttgccgatcgtcattcgtctgatcggtacattactgtccaaagttaacggtatgggcaaactggaatcattcaacgccgtcagttcactgattctcggacaatctgaaaactttattgcctataaagatattttgggcaagatgtctgaaaaacgcatgtacaccatggcggcaacagcaatgtcgaccgtttccatgtcgattgttggcgcttatatgtccatgctggatgcgaaatttgtggtcgccgccttggtactcaacatgttcagtacctttatcgtgttgtcattgatcaacccgtacaaagtgggcgaagaacaagatttgcaactgagtaatctgcatgaaggccaaagcttctttgaaatgctgggagaatatattctggctggtttcaaagtagccattatcgttgctgcaatgttgattggtttcatcgcgttgattgctgcggtgaatgctctattcaccttactgttcggtattagcttccaaggaattttgggttatgtgttcttcccgtttgcttgggtgatgggtatccctgcccatgaggccttacaggtcgggagtatcatggcaaccaaactggtttctaacgaattcgtggcaatgatggatttgcagaaagtcgcttctcaactttcaccacgcagtgtgggtatcctgtccgtgttcttggtttcattcgctaacttctcttctatcggtatcgtcgccggtgcgattaaaggcctgaatgagcatcaaggtaatgtggtttcccgttttggtctgaagctgttgtatggctccacgttggtcagtgtgctgtctgcttctatcgcgggcttggtgctctaagtccccattaacgatcgcttaacgaggcgctacggcgccttgaggttattgacaaagtgcccgcgacggagagaacaggcagatcgtaaagacgccgtaaatacatccatgtaggctcgagccgcgccatccttggcgcggacgctttactcctctgcctatcctcaccgttcaagatcgcgtcatcggggtttgtcagcagtctggaggcgctacggcaccttttttgtatctataattcagcatcaaattatttttccgagtgattatcctcgggggcgaaaggttaggatatttgggtcggtaacctgaaagtcaggattggagtcatgaggcagtgaatagggaataagtagaagcggaataaatgagattgatgggattaataatggtgggtcgtgcgggatgactcggcctctggcctcgcccttcgggtcaacgctgacgcgttgctgtctcgcttcgctcggctcgaacctgaacgcagattttactcgtatcatcctgatactcgccctgcgggccaacacaagtgttgttcaaaattgttccatacaattttgtcacccacacgacatgtgtagtatgcgatttttgagtttgtggggaattttcgaggtactagatataatggtgggtcgtgcgggatgactcggcctctggcctcgcccttcgggtcaacgctgacgcgttgctgtctcgcttcgctcggctcgaacctgaacgcagattttactcgtatcatcctgatactcgccctgcgggccaacacaagtgttgttcaaaattgttccatacaattttgtcacccacacgacatgtgtagtatgcgatttttgagtttgtggggagttttcgaggcactagatataatggtgggtcgtgcgggattcgaacctgcgaccaattgattaaaagtcaactgctctaccaactgagctaacgacccattatatagatttattcaacatttaagtgctaatcatgcgggattactcatcctacggactcgcccttcgggtcaacgctagcgcgttgctgtctcgctttgctcggctcgaacctttaaccaattgattaaaagtaaactgttttactaactgagctaacgacccattatataaatataagctgataggtaaaagaagtggtgggcgataccagattcgaactgatgaccccctccgtgtaaaggagatgctctaccaactgagctaatcgcccacttctactacttatttctactaattctatcaatgagagatgagtggtgggcgataccagattcgaactgatgaccccctccgtgtaaaggagatgctctaccaactgagctaatcgccctcatctatctcattctactgcacaacacatcgagtttggtgggcgataccagattcgaactgatgaccccctccgtgtaaaggagatgctctaccaactgagctaatcgccccgccgtgttgatggagtcgcattatagggatagttcgaagtgagtcaacggtttttaaaacgaaaacaaccgttcgccgcaaatttaaacaggatgcgagatttatcaccgtcactgacgtctctttagccatatatgtcagtaatcatcaattgcaggttggtaacgtcgttgaggaattaccacacagtggtagaatgtcgcctactttttagaatttcgaacaactgtcagcctctgcgggcaggcgtagcgtaataaggcatcaatcccaatgaaaatcaaaacccgttttgcacctagtcctaccggctatctccacgtgggtggcgcgcgtactgcgctctactcctggctattcagccgccatttaggtggcgaatttgtgctgcgtattgaagacaccgatcttgaacgctctacacaggaagctatcgatgccattatggacggtatgaactggctgaatctggattgggatgaaggcccgtatttccaaaccaagcgttttgatcgctataacgccgttattgaccaaatgcttgatgccggtacagcttatcgctgctattgctctaaagaacgcttggaagcattgcgtgaagctcaaatggctaacggagaaaagccccgctacgatggtcactgccgtgacagccaatgtactcatggcgctgatgaaccgtcagtggtgcgtttccgtaacccgcaggaaggctctgttattttcgatgataaaattcgcgggccaatcgaattcagcaatcaggaactggatgacttgatcatccgcagaaccgatggttccccaacctataatttctgcgtggtgattgatgactgggatatggagatcacccatgttatccgtggtgaagaccatattaacaacacacctcgccagattaatattctaaaagcattaggtgcaccagtacctgagtatgctcacgtctcaatgattttgggcgatgatggcaaaaagctgtctaaacgccacggggctgttggcgtcatgcaataccgtgatgacgggtacttaccagaagcgttgttgaactatttagtccgtttagggtggtcccatggcgaccaagagattttctctattgaagagatgacccagttatttaccctggatgccgtcagtaaatcagccagtgcctttaataccgaaaaacttcagtggctgaatcatcactatatcaatagcctgccacctgaacaggttgccgtacacctttcatggcatgttgaacaactgggtattgatacacgtaatggccctgaactcgttgagatagtaaaactgctgggcgaacgttgtaaaacactgaaagaaatggcggagtcctgccgttacttctatgaagagtttgacgcatttgatgtagatgccgctaagaagcacctgcgccccattgcccgccagcctttggaagccgttaaagttaaactcgccgccatcaccgaatggaccacagagaacgtccacaacgccattcagggcaccgcggatgagttaggtgtcggtatgggtaaagtgggtatgccactgcgtgttgccgtgacaggcgttggtcaatcacccggcatggatgtgactgttcatgctatcggtcaagcgcgcacgctggcacgtattgataaagctctggcctttatcagcgaacgcgaagctcaacagtaaaatttatcattttccgtgttatcaggcggccactctggtcgccttttttatatttgataacagcagcggtgtgacaacaaatttgtgaacatcattccatttattatgttatttgcaggctgatttggccgctttttcagcgcttaacacgagaaatcgatttagccgttgacacagtttcgggggtctcatatcatgcgccccgttcacacgatttattatgtgcgcattggggctatagctcagctgggagagcgcttgcatggcatgcaagaggtcgacggttcgatcccgtctagctccaccaaatttcttggtttgattgaacaatcaaatgaattaattggggcatatagataaatcagtacgaacaaccacattcgtggggctatagctcagctgggagagcgcttgcatggcatgcaagaggtcgacggttcgatcccgtctagctccaccaccctttaaaagaccggcctttggccggttttttgctttacagctccgacaggcccttccctcgtacctcatcgataaacgtaaaaccgaacagctaaaatagaccgtgaaaattaatcggtcctctatgccattatcgattactgctatcctgttttcatactgatgatcttaattaccatgaggattgatgatggttccacatcaacaaattattcagtggttacgaactgatccttatcgtatgcaggcactgtatacggctcgtgagctaggattaaaccagtggtgcctggcggcaggttttgtccgtaatctggtatgggatcaattgcatggatatctttccccaacaccgctgaatgatattgatttagtctatttcgataagaaagatatcagtgagcagcatgacttacagctagaggcgctattgcttaataagcacatgcctcataaacaaactgttcataaacaaatggttcataaacaaacggctcaaaaaaacagattcccttggtctgtgaaaaaccaggcgaggatgcatctacatagcggccgcctgccgtataccagcactgaagatgccatcagctattgggttgaaatcgaaaccgctattggtgccaggctcacagatgagggcgaaatcgaactaattgcccctcttggtttagccgcgctttttgccctaacggtcacactaaatccaaaaaacggcgaactagcgacctttgatcaacgggtcaacagcaaaagttggctacagcattggccaaatttacatgtagtcgcttagtcatcctcaaaacagccaaatgataagattgtgtaaatgataagattgtgtaagtgataagatagtgtaaaagtcacttcaaatgctaaaggttaatatctgtccgtcgataagcattattccactcctgtatttctgaggaataataatgtcgaatacaatttctacctcatcagtttcagtcaccagcagtagcacgagtgacagcgcttctgagagcagtacagcggcaaaaatcaagtcccttaatcagcagatccaaaaactgacagaacaattaagtgccttaaaagatactgatttgagcgcagaggaattacaaaaacagcagcaactgattgagacccaaattgcggtgctacgcgctgaaattgcccaaattcaagccgatgatgcagataaaaccaaagaaagtgacaacaatgcggtaagtgcaccgacgggggatggggtaaatcgcccctccgcgcagaatcaggttaacgtttatatctgatggcgttttgtgccttactacgtggtggaatggcgatggttggccgactagatggttggccgactagagatcatattttccgagtgggtctttccatcgccatttgttagccagatttagccggtcttcagcggcttcactaagccgtctaatccttctatcttgatcgctaatgtcatctccatcagcatccccagtttgccctgcggaaattcacctttgcgcgcaaaccataataggtactcttctggcaagtcgatcaacacccgcccttggtatttaccaaaaggcattcgggtattagcaatctcaatcaaattctctttttccatatcgcccccggcgttaggattattcacccagcaaacggatcatttcagcttcatcaataactttaattccgagttcctgcgctttcgccagtttagaaccagccgcctcgccagcgatcaccagatgcgtttttttagagacactgccactcacttttgcgcctaatgctgtcaggcggtctttcgcttcatcccgtgaaaggatcgtcaatgaccccgtcaggaccaccgtttttccagcgaaggggctatcgatctcctcgactacaatttgctgcggctcaggccaactgaccactttctccagttcttcgatgactttctgattatgttcctcactgaggaagttcatcacatgtttagccaccacctcgccgacatccggcacactttttaacgtctcaatatctgctgcacgcagattatccagagtgcggaagtgagcggctaaatttgcggccgtcgcttcgcccacttcgcggatccccaaggcatacaagaagcgtgcaaaggtggtctgtttggccttctccagcgccgcaatcagattttgcgcagactttggccccatccgatctaaccccgtcaacttacctgcggtcagttggaataaatcagctggattttcaacatactgtttctcgaccagttgttcgataattttatcgcccataccgtctacatccagtgctcgccgggagacaaaatgtttaagtgcctctttacgctgtgcagcacagaacaagccgccagtgcagcgggcaacagcctccccttccacccgttcaatatcggagccacacactgggcattggcttgggaaagtgatctccttcgtatcatcagggcgttgttccatgaccacaccaacaacttgtgggatcacatcacccgcacggcgcacaatgaccgtatcgccaatacgcaaaccaaggcgttcgatttcatcggcattgtgcaatgtcgcattactgacaatcacgccagccacctgaaccggctccagacgggctacgggagtaatggcaccggtacgacccacttgaaattccacttcacggacctgtgtgatctgttcctgcgccgggaatttaaatgccgttgcccagcgtggggctcgcgcaacaaaccccaattgctcctgcaaaacaagatcatcaactttgatcaccacaccatcaatatcaaagcccaagcctgcgcggtcttgctctatttgacgataaaaagcaataacctgatcactgccagtgcagagtttcacccgctcactcacgggtaacccccatgccttaaattgcatcagacactgaatatggctacggggtagctcgccgccatccagcagaccgacaccatagcagaagaaggtgagtggccgtttggctgtaatacggggatcgagttggcgtaacgatcccgccgccgcattccgtgggttggcaaagaccttccctcctttgcgacgagcctcttcgttaagctgttcaaaaccggcttgtggcataaaaacctcgccacggacttctacgcgccgcgggacattatccccatgtaggcgcagtggaatggcacgaatagtacgcacattagcggtaatattttctcccgtagtgccatcaccacgtgtcgcggctctcaccaattcaccattttcatacaataaactgaccgccagaccatctagcttcagttcacaacaaaatgtcagtggttctgccgttttaagccggtcatgtacccgtttatcgaaggccagataactttcttcatcaaacacattatcaagagacagcatcggtacttcgtgcttcacctgttcaaaggcatcaagaggcgcggcaccaacccgttgcgtcggtgagtcattagtcaccagttcaggatgttgtgcttctaaatcacgcagttgttgcatcatacggtcgtattcagcatcagggatttcgggggcatccagcacatggtattgatgttcatgatggcgcaatgaagttcttagttgattaatttgttggattatcgattccatagctcatcaccaaagataaaaaacccccggcatgcgggggttcgggttaattcgatttattacgaggcaatcgctttataaaaaagattatcaagcaattgtattcgcatccagcacttcacggatacgcgccttatatgattccaatttctgcggggtcatcatgcggcgttcatcatctaacaccacaccaccgacatcgtcggcaatacgttgggctgattgcagcattaacttaaagttctgattcgcatcgccgtatgacggtaccatcataaacattgaaacaccgggcgttgaaaaatcagacatggtgtcagggtcaaacgaacctggttttaccatattcgccagactgaataagaccggtccgctgcctgcagggctaagatgacgatggaaaatacccatctcgccgaactggaaaccagattgaagaacactttgcagtagtacctcaccaccgatcacaccaccgtgatgcgctgcgacgtgcagcaccaaaacagtttcttttagcttttgtggtttcgcttcgggtgctggagcgacgggctcttgctgagattccacatgctgttgtggagccacctgatgtgcaggtttttccacatgcggtggctctgcgtgttgcggctgtgaataagattcatcagccttgccaagcaaaggatcacgcgataagtcatgcggtggttgttcagcagatagcccacccaaaagcgggtcgtcataatctgtttgtactgaagcaaaaggcgcctgacgagatgctgtcttaacctgagccgattttgtttcagcatgctgaataaccggcacttcatcgtcatcatcgtcaagatgattaaatgaaggcttctcttgtgggtgagacgtgcggacgcgcacttctcctaccccttcatcgagactctcgatcggggtttcaacacgttcttgttttgtacgtttaactgggcgatcgcgaaaaagtgaagagcgctctttacggctggtccacaaaccatgcaataacaacgctattatggcgatcgcgccaacaacgattaatatcagacgcaaatcctgcatcattactatctctgttgttccaatacattgccaccgcggcaaacattcaccctttaactctatttcccaacgaacacaagtgcaagtccgtgctcaattttcttcgaagaaagatgattatgctaggtgtttcgcttaatttttgcacaaaatgcgactatgcagtgggaaatcataccgatatgatacaccggtcaataagattatagtgaacggaatggtatgacctacgtaaaaaaggcggtaataaagtgagtggtttctcttattttgctcaaggatggcgactaatctctcgccctggcatccggcgattcgttattttacctttattggtgaatattctactgatgggcggggctttttggtggttattcaatcggataggtgattgggttccacagctaatgagctatattcccagttggctgcaatggctaagctacttgctgtggccattgatggtgatttcactactgctggtattcagttatctgttcagtactctcgccaatattattgcggcaccgtttaatggcttgctggctgaacagttggaagccagtttgaccggaaagcccctacccgatacagggatctgggggatcgtcaaagatttaccccgtatcatggcgcgagaatggcgcaaattggcttactacttgccacgagcgctcgtgttgttactgctctattttgtccctggcgttggccaaacagtggcaccagtattatggttcctgttcagtgcttggatgctatcaatccaatactgtgactatccttttgataaccataaagtcagtttccaacagatgcgcactgcgctgcgtcagaataaagtcgataacttgcaattcggtgctctggtgagcttattcaccatgataccgttcctcaacctggtgattatgccagtggccgtttgtggcgctaccgccatgtgggttgatcgctatcgcagccagtttattcagctgccatgatcattttcggtgggcgtgtctaacacgcccttgttattgggattaaaacttatttcttaatgacatatcgatataccaattacttacttccatagccatactgttcgcgtatgatttgaacgttccctacattttcatagagttaaaggacgggctatgagcaagatatatgaagacaactctttaacaatcggccatacgccgctggttcgtctgaaccgtatcggcaacggacgtattttggcgaaagttgaatcgcgtaacccaagtttcagtgtgaagtgccgtatcggcgccaacatgatttgggatgctgaaaaacggggtattctgaccgcaggcaaagagctggttgaaccaaccagcgggaatacaggtgttgccctggcatttgtcgccgctgcacgtggctataaattaacccttaccatgcctgaaaccatgagcattgagcgccgcaagttgctgaaagcactgggggcaaatttggtgcttaccgaaggtgccaaagggatgaaaggcgcgattgccaaagcggaagaaattcaagcaaccgatccagaacgctaccttatcttgcaacaattcagtaacccggctaaccctgaaattcatgaaaaaaccaccggccctgaaatttgggaagataccgatggtgatgtagatgtctttgtctccggggtaggtaccggtggtaccctaaccggtgtcagccgctatattaaaaacaccaaaggcaaagccatcacgactgtggccgtcgaacccactgactcccccgtgattacccaagcgctggccggtcaagagatcaaacctggtccgcataaaattcaaggtattggtgcgggttttatccccggtaacctcgacttgagtctggttgatcgtgtagcgctggtcaccaatgaagaagctatttcgatggcccgccgtttgatggatgaagaaggcattctggcgggtatttcttcaggtgcagccgttgctgccgccgttaagctttcagaagaggaaggctttactgacaaaacaattgtggttatccttccctcctcgggtgaacggtatttaagtacagcattgttcgcagatttgttcacagagcaagagctgcaacagtagtctgggctaccgcactaaatgcaaaaaaagcaccctttggggtgctttttttgtggagtacatcaaagtttttactacataaagattgattttaccctccgggtttagtatttaacgggtaattattttgatgcgcgaaattaatcgcgtttcagtcacacctaaggctgaatcgatttacctattttgcagtacaacaaaagatggcatgactaaacgcagattgaagacataatgcaaagagagcattatccttagatgcgatagggtcgtttagatctgtccccaagtcagaatctaaaactgtctttgtgagttgccaacggttaaggcatagtcatgcgcaggccctatattgtttcgttatgcgtatcgttagtcatgctaattgttagcaaaactaattgttagtaatgcgcacaccaatacaggctaaagtttggaatttacactaaactttagcctcacaacataaatccaataagttggggaaacacaatgttccagcaagaagttactattactgctccaaacggtctacacacccgtcctgctgctcagttcgttaaagaagcgaaaggctttacctctgaaattactgtgacctcaaacggtaaaagtgccagtgccaagagcctgtttaaactgcaaactttgggcctgacccaaggtactgtagtctcgatctctgctgaaggtgaagatgagaaaaaagcggttgagcatctggtaaaactgatggcagagcttgagtaatcaacgcgctcttttttagttaacaccagtcaagagtaaggtagggttatgatttcaggcattttagtatcaccgggtatcgcttttggtaaagcacttctactgaaagaagatgagattgtcatcaaccggaaaaagatctctgctgaccaagtggagcaggaagtcgagcgtttcaaagctgggcgcgccaaagcggctgaacagttagaagcgattaagaccaaagctggcgtaagcctaggcgaagagaaagctgccatcttcgaagggcatatcatgctgttggaagacgaagagcttgagcaggaaatcatagccctcatcaaagatgagcatgcctctgctgatgcagccgcttattctgtcattgaaggccaggcaaaagccctggaagaattagatgacgaatacctaaaagaacgcgctgctgacgtacgtgacatcggtaaacgcctgctgaaaaatattctcggtctgaacattgttgatctgagtgcgattcaggatgaagttattctggttgctaccgacttgacgccgtcagaaaccgcacagcttaatttggataaagtgttagggttcatcaccgatattggtggccgtacctctcacacctcgattatggctcgctctcttgaattacctgccatcgttggtaccagtaatgtgaccaagcaggtcaagaatgatgattacttgatcctcgatgcagttaacaacaaagtttatttgaacccaactgccgatgtgatcgagcagttaaaagcggtgaaaaaccagtacatcaccgaaaaaaatgaactggctaaattgaaagacctgccagctatcacccttgatggtcatcaggttgaagtggttgccaacattggtacagtgcgtgatatcgccggtgctgagcgtaatggcgctgaaggtgttggtctgtatcgtaccgaattcctgttcatggaccgcgactctctgcctacagaagaagagcagttccaggcttataaagcggtagcagaggccatgggttctcaggcagttatcgtccgtacaatggacatcggtggtgacaaagatctgccgtatatgaacttgccgaaagaagaaaacccattcctgggctggcgtgctattcgtatcgctatggatcgcaaagaaattctgcacgcacagctgcgggcaatcttgcgagcgtcggcgtttggtaagttgcgtatcatgttcccgatgattatttcggtcgaagaagtacgtgaactgaaagcagaacttgaactgctgaaaagccagctacgtgaagaaaataaggcctttgatgaaactatcgaggtcggtgtaatggttgaaacacctgcggcggcggttatcgctcgccatttagctaaagaagttgacttctttagtattgggacaaacgatctaactcagtatactctggcagtagatcgtggcaatgagctgatttctcatctctataatccaatgtcgccatcggtattgggcctgatcaaacaggttattgatgcatctcacgctgaaggtaagtggaccggtatgtgcggtgaacttgctggcgatgaacgtgctacactgttgctattgggcatggggctggatgagttcagcatgagtgcaatttcgatcccacgcatcaagaaaattatccgtaatacgaatttcgaagatgtgaaggtgttggcagagcaggcactggctcagccaacagcgaaggaattgatggatttggttaccacattcatcgaagagaaaacgctctgctaattccacgatactgggacgctgcccaatataaatacttaggagaagatcatgggtttgttcgataaactgaaatcattggtttcagatgataaaaaagacagcagtgttattgagatagttgcaccgctgtctggtgaaatcgtcaacattgaagatgttcctgatgttgtttttgcagagaagatcgtgggcgatggtattgctatcaagccctctggcaataaaatggttgctccagttgacggcaccatcggtaaaattttcgagaccaaccatgctttttctatcgagtcagacagcggcattgagctgttcgtccacttcggtattgatactgttgaactgaaaggcgaaggttttacacgtatcgctgaagaagggcaacgcgtcaagaaaggtgacgtggtgatcgagttcaatttggccctgctggaagaaaaagccaagtctacattgacacccgttgttatctctaacatggatgagattaaagaactgattaagctttctggtagcgtgactgtgggcgagacacctattatccgcatcaagaaataggccgtatcaacaaacagttcatatcgataccgataaaaaacggcgctcaagggcgccgttttgctgccggccatgatggtcttttagcctttcctatctcttatcgtagtggccttctctcgtctccactcactacaccttattcactcactacaccttattcactcactatctcttattcaatcactatcgcttaccgctcaagcctgccaccgtggtactcgtaatgttatcaccagaccaccctgctcgccatttcgcgcctcaacctgaccaccatgggccagaatcaccttatgcgtaatcgccagccccaagccgtatcctttgccggacatcgctgatttaacacgaacaaaagggtcaaaaatactggatagtttgttttcctcaacccctgggccttggtctataacctgaatttgatagcgcttatccagcgcagagagtgtcaccttaacctgttggccacttgctgaaaaccgtagcgcattgcggacaatattttcgatagcacgccgcatcagttcagcattacctttgacggtatactcactctgtgccgcgacctctaactggatttcaactcccggcagttgtgcttcgtagcgggcatcattcaccacgactttaactaattcctgtaagtcaaaatactcatcatcatcggccaggctgtgattttcagcacgcgatagtgccaataattcaccaatcattttatccaaccgttcggactcatgctcgatgcgctgtaatgcgttgtctacgttgccagggttttgatgcgctaaaccgatagccaattgtaaacgggctaatggagaacgtaattcatgagaaacgtcatgcaataattgctcacgtgcactgaccagtgcctgtaggcgttcggccatcgagtcaaagtcccgcgcgacttcagtaagttcatcatgccgacggcgcatcactggaagcaaccgcacagataaatccccctgtgctacccgttcaaaaccgacacgtaattggcgcatgggccgtgtcaagttccaggctaataacgtactgaaaaataagccccctaatacccccatccagatcattgggattggaacattcagtatttcacggcgatgtttatcaggggcatttgccaagtttgctgcgcgtaaaccttcaatgtcgtagctgacacggtagttttccttgtcaggtgcggtgacccaagtgacgatttcgctactgtataacttaggttcttccccagagagagccgatatatctttttctgccgtatctgccatctcggcaggtaagacagaaaaatattttttgtccgcttctggccaatcagccatcatagcgtttaaggctggctgaccgccggtatgtaatactgatgcggctgaaacaacctgcaaccgggcaatctgccgaacgaggtcattctctggtggctcatggcgatgaccataaaaggaaaaaatcacccacaacatctgagtcatcaaaataaacgtcagccaaaaacccaacaggattttccagaataatcttccgcgcataggttatctcactccgcagtgacggttatcggatgcgatagccaatgctacgtaccgtttcaatatttaaatgattacccggtagggcggcgagtttctggcgaatattactgatatgcacatcgacactacggtcataggcttcgcgaggccgccctaaccctttatcagatagttcgtctttagtcaccacgcgttcaggtgaacgtagcagcagctctaatagattgaattccgatgcggtcagatcaaacggtttaccctgccattcgctactgcgggtagaggggttaagtgtcaatccgccttgcgtgataataccgctatcaatggaggacaaagttggctgctcttcaaaacggcgtaaaacagcgcgtaatcgagccaccaattcacgtggatagcacggtttaggcatgtagtcatccgcgcccatttcaagaccgatcacccgatcaatattgtcgcctttagccgttaacataatgatcggcaaacggctttttttacgcacttgccgtaatacatcaataccactcatatcaggcaacataatgtcgaggataagcgcggtgtaatcgccggacaaggctccatcaatgcccgctttgccggtcaatacatgtttggcagtaaacccctctccgcccaaatattccttcaacatcgtgcccagttcaagatcatcatcgactaacaaaattttcatttttaactcccctacctgattccagctattttcgtgcctattccaataccatgcagccagttttactcaatccttacataatcttgaatctcacttaacccacatgatccaaccttagcggtaaattacgcctctgtgttttattacctcgcagccttcattgtcgttcaaggatttttgattaattatgcaacatgttactggttcaaaacgacgccttatcgggtgggtagttttgctactgatcatcggtggcctgctattcttcagatggatttcaccaccagataaaccaagctatatcaccgccgttgctgaaatccgcgatctggaacaaacagtcttagcggatggcacgattaaagcacagaagcaggtgactgtcggtgctcaggtttcagggcaaataaaagcccttcatgtcacattggggcaacaagttgaaaaaaaccaattagtggctgaaattgatgatcttgctcaacaaaatgcgctgaaagatgcggaagaggccctgaagaacgtgcaggctcaacgggcggctaaaatcgcaacacaaaaaaataaccaactcacctaccagcgtcagcaacaaattctggcaaaaggggttggcgtacgtgccgatttcgatagcatcaaggccaccttagaagcaacgcaagcggaaatcagtgcgttggatgcgcagatagctcaggccgaaatcgccgtcagtacggcaaaacttaatctcggctataccaaaatcagttcccccattgcgggcaccgtggttgccattccggttgaagaggggcaaaccgtgaacgccgtacaaagtgcgcccaccattatcaaagtcgcccaactcgacaccatgactgtcgaagcgcagatttccgaagccgatgtggtcaaagtcaaaaccgggatgcccgtctatttcactattttaggcgaaccagaaaaacgttttagtgccacgctgcgggcgatagaaccggcccctgactcgattaatgatgaaaccacaaccacatcgtcatcaacttcaagtagcagttccagcagtacggctatttattacaacggcttgtttgatgtagccaatccgaccggtgcattgcgtatctcgatgaccgctcaggtatatatcttgttgaatcaagccaaaaatgcggtggttattccagcaacggcattagaaaatgaccaaggccaatatcgggtacaggtggtggacaacagcggtaaagtcagccaacgcacggtgactgtgggcctcaataataatgtggatgcacagatcctcaccggcctgcaagccggagagcacgtgattgttagtcagggcagcaccacctccaccaacagtaaggccccacgtatgggcccaccgatggggatgtaactgatgacaggaccacaacaaggtaaaattttgctccggctcgaaaatgtcagtcgtgaatttataacgggcgaacagaccgtccgcgtgctgaataatatcaatttaaccctccacagcggagaaatggtggcgattgtcggcacatccggttcaggcaaatcaacactaatgaatattctcggctgtctggataaacccagtgctggtgaatattgggtagcgggacgtatccctcagtatttgggcagtgatgctctcgctgaactgcgtcgcgaacactttggctttatttttcagcgttaccacttactgaacgatttaagtgcgcgcgaaaatgtcgaaatcccagcgatttacgcaggcattgatcgtgaagaacgtcgtaaacgggcggtcaatctgctctcacgtattggattggctgaacggctggactatcggcccagccagctctccggggggcaacagcagcgggtcagtatcgccagggccttgatgaatggcggtgacgttattctggcagatgaacctactggggcgcttgacacccacagcggcaacgaagtcttaaatatccttaaggacttgcaccaacagggtcataccgtggtgattgtcacccacgatatgtcgattgcagaacatgctcaacgcattattgaactcaaagacggcgaaattatcgctgatcggccaagggatcacgcacaagaaaagccaaaaatggtcgatatcccttctgtaatcgatatcccttctatggacgagaaaatatctacgggagcacaacaagagaccgaaattgcccgcaaaccgctcctgacacgttggaaagtacagtatgaccgcctacacgaggcgttcaaaatggcaatactggcgatggcggcacagcgcctacgcaccgccctaaccatgctaggtattattattggtattgcatcggtggtctcggtcgtcgctctgggaaaaggatcgcaacaacaggttctggctaatatcaatgcgatggggaccagtacactggaaatttttcccggtaaagattttggcgatatgcgctccgcggcgatccatactttgcgggataccgatgccgatgtgctggcccagcaagggtatattcatagcgtcacccctaccgtttcgaccagcgtgacactgcgctatggcaataaatcggtcagtggcacagtgaatggtgtgggtgagcaatattttctggttcgcggttacacgatagctcaggggatggcatttacccgcaccagtgttaacgacttgatgcaagaagccgttattgacgaaaacacccgcgataaactcttccccaacggggaaacgccattagggaaagtgatcctgcttggttccctgccctgccgggtaattggtgtggcggccaagaaacagagcgggtttggcagtgatgaaaatctgaatgtttggatcccttatactacggcgatgaaacggatgctcgggcaatcctatctgaaaagtatcacggtgcgagttaacgatgatattgatctggcgaatgcggagcaaggcgtgatcaagctactgagccaacgccacggcacccaagattttttcgtaatgaatacggacagtattcgccagaccattcaagcaaccacatcaacgatgacgttgctggtatccatgattgcggttatttcattgatcgtcggtggtattggcgtgatgaatatcatgttggtctcagtgaccgaacgcaccaaagagattggtgtacgcatggctgtcggtgcacgggccagcgatattatgcagcagtttttaattgaagctgtcttggtctgtttgctagggggtagcctcggtgtcgccttatcgttagggatcgggctattattcagcctgtttagcagcaacttttcaatggtttactccgcggcctcgattattaccgcttttgtttgttccagcttgattggggtcatttttggtttcttccccgcgaaaagagctgcggagatggaccccattagggcgttagaacgggagtagtggcttggtcatcacgatgaggtcgatggctttcatcgtgataggtcatccgtgaccttttattgttatcatgactctattgcaataaaactaaaaaacttaccgccactggctttcctcatttattttttgtttcatcatgaggtattttatacccatcgtccttcacgctgcaggggagttagctgccctgactgccttactgcaacgcgaattattttgggtatagatgccctttttatacaaaataaacatcaagcattagcataattaaaggtcaaatatcccccatctaaattagccacggtatagccatattgagacagaattcttgcagcaatgtaccctcttagcccaacctggcaagtcaccagtatctttttatcttggggtattaatgccaatttttgacgcaattcagacagagggatattcaccgcagtttttatactgccggagataaactccgcctcatctcgtacatcaataataatccccccatcagccataaaggcatccacttcatgccattgcttcgtcatcacatcgccattcgagatattttctgcaacataacccaacatattgaccggatcttttgctgacgaataaggtggggcataagccaattctaagtcgggaagatcatagatagtcagcctgcctttgatcgcggtcgccaacacatcaatgcgtttatctgtccccccctgaccaacagcctgtgcaccaagaatacgcccgttctctggcgagaataataatttcaatgaaatctgatgagcgccaggataataactcgcatgtgacatcccatgaatatgaacaacttgataagggatcgccaaacgctttaacagacgttcgttgttacccgtacaggcggcgctaagatcaagtactttggcaatcgcagtgcctaatgttccgtgatagcgcacatcacggccattaataatatcagccaataatctgccttgccggttagccggccaggccagtggaatatacgttgcctgaccattgatataatcgacaacctggatagcatcaccgatagcataaatatccgctacactcgtctgtaatttctcattaaccaagatgctccctctgatccccaaatccagatgagctttctttgccaagtcattttcaggttcgacacctatcgccagaatgaccatgtcggtggtaataattttccctgatttcaaatgtatttgatgtgcagattcatcgaactgtaccactgcgtcattttttatcacatcaacgccgttgtcttttaaatgcttttcgacaatcgctgccatttcataatcaagtggcgaaagaatttgatttgataattcaataatagtgactttcaacccactactcaccagattctccgccatttccaatccgataaaaccaccaccaataatggtgacagcttcaggtgtagcggaaattagatacgctttaatattgtctgtatctaacatattacgcagggtaaatacagagctatttactgacagaccggcaatgtctggaataaaaggacgggcacccggcgatagaattaatgtgtcatattgtataaactcttccttacccactttatgattaatcacagtaatggttttactcgcactgtctatatcaacgacttcattttcagttctgacatcaatattaaatctatccttcattttctctggcgtttggattaaaagtttatctctttcggtaataacaccaccgatataataaggcaagccacagttggcaaaagagatatactcgcctctttctagaataataatattgtcatattcatttaaacggcgcaggcgagcagcagcactggcaccaccggcaacaccaccgacgataacaattgtttttcccataactctttatcactcagattaggacggccacttccagtttgaaaatggcctattggttattaaacagtgacttctttataatagcttcttgttaaatatgagatgaagaaagtaacgataaagttcatagcaaaggcgacaaccccaatattcatatactcaaagccattagtaatgaacgggaaaatatctgctattgaaatatgatagacataggtgaccgccaaaataatgacaccgaccataatccccgaaaaagcgcccgcagtcgtgattggattctttttgcaaaaactgaatataagcgctgggaagaactgagcaattatattgacaccaagtagcattatagcgaccagcgtatcattgccattaaagataaaatacaaagagaccaaggcaacaacaggcaccatatagcgagaaagatttcccgatttatttttctccacatccaggcggaaaatcttttggacgacaccggccagcatatttgccgtcgccagtaataacatagaacccggtaccagtgctgtcagcatacctgccgcaccaataaacccaacaatataacttgagaaggttgattttgatatttcaaataaagccaggtcaacatctggcccggttaagtcagggacatttaagattgccgcaaaaccgacaaaaaaggcaaacagcatgaccagactgtaagccggaatcagtatgctattacgctttaatgaggtttcatttttggctgtaaatacagccgtcatatagtgtggccaacagaaataagcggctacggataagaatacggtagagatataccaaggtatgttgagtccttctttcgggaagacaagatacccaggattaactgtttcaatagattgaaacatgttgccaatactaccgtagtagtgaattggaatataaataccgataaagacaaccacaaacaagatcatgaaatcttttaatacagatgtccaggcagaaccatgaattccagaaatcatcacaaaaacagagactgaaatcacgccaatccatattgccatattggacgatatagagccataagatgcttgtgagacaatgatcccaagtccttttaattgtaaaatgaaaagcggaaccattgcagcgatagagaatatgctaatcagcatacctaatgatgaacttttatatttcagtgcgaagaagtctgaaatagacctaacattattatctttagcatacttccaaataatagggtgaagccaataaagtgatatccccataaaggcattaacggtgagcgtatataatatggctgggccttttccataagcccagccactgccccccaagaatgtaaatgttgtgtatatctccccagcactcagtagaaatactaataaagcgccgtagctacggccaccggtggtccacccttcatggtccatcttcttgccttttttagagcgaatggcaagataaatactaaacaggaagaatgtacatattataattaatggcgcattcatacttcctccttacttatatttgaatccaatttcgagattatggccataatcaatgcggtcagaatcaaccaaatcacgatccagaacataaggaatggcatacctaatatgaaaggttccactttgttaacaaagaaaataccgacagttaatgataatacaggtagcaacacgagagaatgataccatttcatagttaactcctactgcgtagcatatacccgtcatacttcaagctgcatgtgcgttggcggcgtttattactcagcccatccagcggcctcgcctccgcgaggccaatgcaactcgaacgatttaaggtatagaatacagtttttaattaaaagaaactaaatccctgggtaatttactcaaaaactcaataccctctttatttattaaaatcatatcttcaatcataatcgaacccaaattatagccgtagtaaggtgtttctaaacttagcaccatacctgaagtgaacgattctgtagcatgagtgctaacgaagggactctcttctaatcccaaaaagacgccattaccatgcccaagatgccctctgttataattaggtaacccggactttttaataacctccatcgttgaatcaaatacatctttcattttgacgccaggcgcaaccatactcagcatatgttcatgcccagttcttattgtttggtatatcttccgggtgatctcgggaggttccccaacaacaaaagtcctggcaatatcggcaccataaccatcaacatcgacgccgcaatcaaatttaattaagtcgcctgaacaggctttagtattgcttggtatgagtttgggtgaaaaatcagcgccaacagagataagatggaatcttgaaaagtgagtttcagatttactcattactgctgccttatatgcggcagtgagttcagctgatgtgcatcctacccggatgagctttgatgcttcagtgatcccatattccgtaatttctgcactttttctgagtcttttaatttcccaagggctttttatcactcttagctcgttgaatatagagcttgagtcgacaaaatcaacattaggcataacggcatcaataactcttttaccaccgtttgacattatattgaggtctattgctatttttttattaagtaccctggcatcgttcaatgcgtctttgagtatattacatacactctcaataggaggacctatcggcctctctttattattatttgcagaatcgcgcatgttaaacggatcatctacatctacccaaacaggaaaggtctttaattcagcatttggcatatccaacgttaagctggctgcttcaaattcattcataatgattagcgatggaattttcacatcacggaagacaacggcgatagccgtgcccgtattccgaaaggtatacataaaaaaactgagaataccggtaacatgataaaaattatcacacgttgtcacaatgacagcatcaatattatcacgctccatgatcgttcttaactttcttgatactgtattaagatgttcttttttttcactgttcatttttatcccctgcaaaataacctatacgctattctagtttaaatcatctaccgcgtattttagttgtattaatgcactggtgaggactgattttggacaaccaatattcatcctcatgaagttttcaccactttcgccaaagatgtggccttcgtttaaggctaattttgcttttgttagtatgaattgctccagttcatacggagtcaaccctagcccacggcaatctaaccagagtagatacgttccctcaggcttaaccaatgtgatcttcggtatatattttttaaagaagtccacagcaaagtctagattatgttgtaagtaacccagcaaactctctaaccactcctcaccttctttatatgctgtttccaatgctatcacgccaaagggattaggattccctaatgccaggctatttaattcggtttcatatttattacgtaattcttgattagggataatgatcgctgaagtttgtgtccctaaaagattgaaggttttactgggtgccatgcaggtaattgaattattttcgaaatcaggtgagatagcggcaaaaggagtgaatttactgcctttaaaaacaatatcacaatgtatttcatctgcgatgacaatcacgttatgccgtaagcatatattacccatggtcgtcagttcatcccgtgtccatactcttcccactgggttatgaggattgcaaaggataaacaatttcacgccagtggcgatacacgcttcaaaatgtgcaaagtctatatcatatttttcgttaccatagagcaattcactcgcgacaacttcacgatcatttcgtgcaataacattggcgaagtgatgataaacaggggattgaatgagtattttatctcccggttttgttaacccacgaatagccatggctaatccaggaacaacgccggggctatgagagatccactcaggcttaattaaccattgatgtctttttttaacccattgtgtaatggcatctaaaaaactatcaggtctgaaagtatagccataaataccgtggttaactctttcggaaagtgcactaatcactgagtccggagatctaaagtccatatccgcaacccacataggcgttaaatcagtcataccaaatcgagcatttaaataatgagcatcccacttttcacatgctgtattacttctatcgatgacttcatcaaaattgtagtccatgtccctttcctcactggttcgacttgtaaggaaatttaataccattatcttgataatttcttactattaatactcctaattggtggtttttttagaaaaatttacccttaaaagtgcatcgtactagtattaatgatttcgacaagtatctctccatgcgcgccacattaacttattgatattactataattattttaatgctgaataattatagtaataaattaaatgtgatatatctcaacataaaaatgtaattaatctatttattacttttatttgtgataaacatccaaatatcaaatgtgactaaccgcaaaaaatagcaactaatgctttattaatttttatttaggagtaataaactaaagaaaggattaatttaggaataaaaaaccaaaatatattcagtgatgcgtgaaaaaacagtaatgaattgattttataggataaacaacctcaccatccttttcctttttttctccccgcttgggaatttatttttctcttattcccccccagaattcctatatggttattcattcctctgactacattaccggctattcagcacggtgttcatgacgctaattggccgttttacaaatttttgacaactttatacagcaaacagacaacttagcgcatgataagatgaataatcgtggcactactcttcgagtcttgcacagaggtactatcgtgttactaaaaccagccattttaataaaaactgacatgctaataaaaccagacatcctgataaaaccggccacgctaataaaacaggccgctcgaataaagcagatgaccctattgttgctattattccttttttcgctgtttggggtagccaaggcggcgacacaagtggtcaatgtcaaatcagaacttgctgcgcccgttatgctggctaatagcgaagataaaaattacctgaaaatttctcttaccggttttaatctcgacagcacccgtcgtagcccaatcaatctggcgctggtcattgatcgttctacgtcaatgagcggtgagcgcatcgagaaagccagagaagcggcgattttagcggttaatatgcttaacaccaccgatacgctatcggtggtggcctacgataaccacgccgaggtgatcattccggccacgaaagtcactgataagccagcgctgattgccagcattcaacagcacattcacccaaggggaatgaccgccttgtttgctggtgtcagtatgggtattggtcaagtggataaacacctgaaccgtgagcaggtcaatcgcatcatccttatctctgatggtcaggcgaatactggccccacctcaatcagcgaactttccgatctggcccgcatggcggctaaaaaagggattgccatcaccactatcgggctgggccaggattataacgaggatctgatgactgccattgcgggttatagcgacggtaaccacacctttgtcgctaactcggcagatctggaaaaggcgttcaccaaagaattccaagatgtgatgtccgtcgtcgcacaggatatcgttgttcagattaagactggcgataaggtgaaaccggtacgactactggggcgcgatggcgatatcctcggcaatacagtgaatgtgaaactgaatcagctttactctaatcaggaaaaatacattctactggaggtgattccggaaaaaggcactgacaagcagcaaaaagatctggccgatgtcagtatcagctacctgaatctcagcagtaaaaaacaagatcagattaatgaacgagtgaccgtcagctacagccaatccgtagaaaaggtcaacgatgctgtacaagaagaagtattagcggagtcagagattcaaaaaacagcgctggccaatgatgaagccattaaattgatcgacgcggggcgcaaggatgaagcgaagaaagtgctagagtccaatgcctcaaaactggacagcatgtcgttctccagcccggttgcagagaaaaaagtgcgagagagtacgaataaacagcgtaaattagcggatgacattgacagtaaagatgccgccacttaccgtaaagagctgaaagaacagaactacaacgtcaaacagcagcagaagtaaaaataaaagtaaaaataaaagaggttattgacaaagtgcccgcgacggagagaacaggcagatcgtaaagacgccgtaaatacatccatgtaggctcgagccgcgccatccttggcgcggacgctttactcctctgcctatcctcaccgttcaagatcgcgtcatcggggtttgtcagcagtctgaataaaagttcatttatgctgagtcagtacgctggctcagcgtttacatgggatatggcatgaagccgtcaaaaagcctgtttctttttacctctatcacgttcttaatctgcgcggctatcgcctacttcggctatcgcagcctcacccatgaaacactgctgcgccattatcagaaccaacgtctggcacagagtcataccacacaggtcagtacatttattctggatctgctaaaccagaatgccgtgcgtctgggttcgcttgtttcttatattcagttagataatgcgtcgctaaacgccctgatcgcgcaagagagtagtattgacgccctatttgtattgaagaaaaaccaactcttgtaccccaatactcaagcagccttgaccgagaaagagaaagcctggatacaagcgatcacccctatcattcaggacccgagcctgctctacagccaccactataccgatgaacagacccggccaacctcaggctggtacctcagtcgcgaactcagcgacccactgttgatatattggcaggcgcgggataatcaactgatcggttttaaagtcccctacgtcaagctgctgtctgatgtgattaacaccatgacatttgactctgcaccgaacacactgcaagtcctggatgatgggcgcttgctctaccaaagcggcagtgaagagctgttaacccaacaggtgcccttgaattcccaacgcctgccttatccgctaggtgcctggcagatagattattacgccaaggcggtaaacggcgcgcccctttatctctggggtgggctgctgttattactgctgatggtgacagttgggctggtcatgctatatctgtatcgagaatacaaccgccagttacggcttgctcaacagcaggtgagcttcgtcggccaggtatcccacgaactgaagacgccactaaccaatatcaccttatatgcagagatgttgcaggagttgcaaccagagcagagcgttcctcccaccgcagagcagcgctatctggaggtgatcctcaatgaaagccagcggctctcgcgcctgattcagaacatcctcagttttaccaaagcgccgaaactccatctacaaacggtggcgctgcgcccattgctgaacaaaatttatcacacttttattcccgcgttttccgccaaaaatatggagttggtgctgatcattaataccgatattcacctcacgaccgatgtcgatcgcttgacgcagattatcagtaattttctcagtaatgccgaaaaatacgcctcacaaggaaaacgggtggagttgattggtgaacaggctgatgaccgggtgttgatccacgtaagggactatggtaacggcatcgccgcaaaagagttaaaggcgatcttccagcccttttatcgagtgaagagccatatcactgaaggtgtttccggtaccggtattggtttaaccatcgccagccaattagccgccagtttgcagggcgaaatttccgtcaccagtaatccggcgggtagctgttttaccctaaaactgcctatgacgattaagcaagatgcggccacagacaaggagcagttcacatgaaaatattaattgccgaagacaatgcccatattcgtaatggccttatggaagtattggcccatgaagggtaccgccccatcgcggcagaaaatggtgtgcaggcactggcgctataccgccaacaacagccggattttatcattcttgatatcatgatgccggagcttgatggctacaaggtgtgcagggagatccgcaaacacgactggcaaacgcccattatttttctgtccgcgaaggatgaggagattgaccgggtgatcgggttagagttgggtgctgacgactacatcagtaagcccttcggtatccatgaaatgcgcgcccgaatcaagactattgtccgccgttgtctacgaaaagtacctgaatccgccgaagacgcaggcttcccgtttggcgatctgatggtgtttcccaatgagttgtgtgcgattcgtggagagacgcgccttgagctgtcactgcgcgaggttaatatcctacgctatctgtatcagcataagggccgggtggtcaccagagatatgttatttgatgcggtttggggatatgaccatttgccacagagccgtacgctcgaccagcatatttccaagcttcgcaagaccattgaactggatccggttcatccggtattgatccgcacagtgcacggggcgggttaccgttatcaaggcacggcgcagagcctggaaaaatagatcaatgaaagtttgcggatagatcctgacaatccctttgatattttcaacataataagtttcctgcccccccagataaccgggatattgtgtcttgatttcaccctgtgcttttcattgggatttggcttactctagtgcctgcaactgaacttcggtgaaaatacaaccttattaccataattttcagtttctgccctgccaaaagaacagcaaaaatggattctatgcgggcattagagcaagggtaatcattaaagaagaggatgccgctagaaaatccgtgttatatgcaccggatatcaagtgacatagcctcaaatttataatactcagaatagaaatttttccattctagtagaaacgtatcgatttaatagtcaaacataggaaggtatgaagttactttttcttttaggaaaataagtttcccaaccaggcagtgaaaatacctcttcttgtgaaataaatgctccctccaagcagaattgaacattattttttacattagggtgatctttacgacggtaaagccatctcaactcagaggctgtgatataggtaccataatcaggttttttttgtgcaatttcaggaatacaattattcaaattatctatacaaaaaaatacacgctcttgcctttccatgatctgaaattcaagaccagccttactggtccttgataaacatatatcctcctcatttttatgaggacggtatgattttattcccgaacgacttaaaatattatacttttcatgtttttctaggaaatctttgaatttaattccgcgatcagcatcatttaacatttctttgattgtcgcatcgtctctatatttatcacgggaaaaataattacgatgttcccaaacagcatcagtaattgttgtttgcgaacaaatatctttgttagaaaagtcattaaaattaattagttgctgcatcacctcatgttgacactgagcaattccatatagaatgtcccctaatttaaactctagagctacggatggcactagaccattcaatcagatctctctatccttgaatttgcttttttcaattaaaaaactatcacttaaattaatacctcttaaatttttaggaaatttatcaaacgagagagaaaggcgctctttcgagtctatatctaatttaatatattgtaatgattcaggcagtggaattatagcatttgaaattttcggacaagatattatttctaatttagtcaaacgctttggtgcattcttatataaagatgaaatttcagggcaatggctaatttttagcttagtaagctcggaaggaaaactgtcagggagagtagataattcatcgcaataataaatttcaatctcgatgagactatgcggtaaaacatcaggtaaagaactgatattcagacgcgatagcctaagtataggcgcatttctctctataacatcacgaatttcattagcagcattggttctgttttccccaaatggagcatcattctcccatttatttactgaattcaatgcctctttatttttttcattctctgttgagagaaattcaatctcaactctattctgagcactaataaaattaactattttcatagaaaaataatccttaacaaattacgatgacttatttttatttccattacgtttattttacttggttaatatcattatggctttcagaaaacattatttcttattattataacattattaataatgtatttactgctgattaaaaataggttttcaataaaaatgctatatcttgattgaatattcgggctgtcataaacagccctcaccagacttaagtggaggaaaaatttagccccccttacttaaaaaaaccccagttgataaatagcggtcaccacggtcacagataatcgccacaatcaccgcatcagggttatctaccgcgatccgcagcgccccagccaccgcaccaccagaactgacgccacagaatatcccctcttctttcgccagccgccgcatggtttgctctgcgacactctgcgtgatatccaacacctgatccaccagctcggggcggaaaatacccggtatatattccgctgaccaccggcggatccccggaatactgctgccttctgctggttgcaggccgataaccttcacctgcggattttggctttttagatactggctgacaccggtgatcgtaccggtggtccccatactggagacaaagtggctcactttacccgccgtttgctgccaaatttccggcccggtccccgtaaaatgcgcatagggattatccgcattattaaattgatccagcacgttaccttcgccgttctcctgcatggttaacgccagatcacgcgccccttccatgccctgttcacggctaaccagaatcagttccgcgccgtaagcccgcatcgccgcctgacgctcctgactcatgttttctggcatcagtaacttcaagtgatagcctttcatggcggcaatcatcgccaaggcaatcccggtatttccactggtcgcttcaatcaggacatcaccgggggcaatatcaccacgtaactctgcctgctggatcatcgccagcgcggctctatctttaaccgaaccggccggattgttcccttccagtttgacccaaatctccgcatttagcccttggcttaagcgttgtagtttcaccaatggtgtatggccgatgcagtgttccagggttgtcacatttattacctttaaatacccttggcccttgacgttgcaacggtgttcgccgctctcatgaacccgaatgactgacgcctgtcagctcatcagggtttgcgcgttagcggccttgctgcaacaacaatgacttgggtaggttctttatttgcaaaaaagaagaaaacttatcaggcgctttgggctaaagcaatgggttgcaataattgattgccagaatataagcgtgcatttaacccgccaacataataacggttgccgcgcaccggggcatcaatattcccctctgggagcaccacactgatcgggtcctgatgccagccgatgggttgcacggttaattgccagaagtgaccacgggggctaacttcaagcacctgaaccggcagtgggcagcgatcacttgattgcgtactcacttccatctcccaagggcgcaggaatagatcgacactgccctgatgcatcggtgcaagatccagcggccagtgatgtgcgccaataaacagctgcgaaccgcggatctccccgctcaggcggttaacttcacccagaaattccaaaacaaaacgggttgccggttcacgccagacttcatccggtgtccccacctgctcaatattgccctgactcatcaccaccacccgatctgcgacctccatcgcttcttcctgatcgtgggtgacaaagacactggtgaatttcagttcttcatgcaactgacgtaaccaacggcgcaactctttacgcacctgtgcatccagcgcgccaaaaggttcatccagtaacaaaatctgtggttcgaccgccaatgcacgcgctaaagcaacccgctgtttttgaccaccagacaactgtgatggaaaacgctcggccagatgccctaattgcaccatttccagtaattgccccactttctgcttaatggccgccgcattcgggcgctcgcggcgcggtaacaccgtcaaaccaaaagcaatattatcgaacaccgtcatgtggcggaataacgcatagtgttggaaaacaaacccgacccgacgatcacgagcatgtaaccggctgacatccgtgccatggaaactcaagcgcccggcattttggttttccaacccggcaataatccgcaataaggtggttttacccgaaccagaagggccgagcagagccaccatttggcctgaaggaatatcaagcgtaatgtcattcagtaccttggtccggccaaaatacttactgatattattaatttcaatgctcatgcttttgctcctgttcgagacgaacaacctgacgcgccaagcgccattgcaggccgctcttcagaaaaagggtcactattgccatcagagtcagtaacgcggcggcagtaaatgccccggcggtgttgtaatcctgatgcagcaattcaacttgcagtggcaaggtatacgtctcgccacggatagaaccggataccaccgagaccgcaccaaattcaccaatcgcgcgggcattggttaacaccacgccatacaacaacgcccagcgaatattgggtaaggtgacccgacggaacatctgccaacctgaagcgccgagtaatacggcagcctcatcttcctgactgccttggctcatcatcaccggtaccagttcacgcaccacaaaaggacaggtgacaaaaatggtgaccagcaccataccgggccaggagaacatcaactggatatcgtgggcatcaagccaaccaccgaccaccccatttgagccgtagaacaacaaatacatcagccccgccacgacgggcgaaaccgcaaacgggatatcaattaacgtcatcaacaattggcgaccggggaaaacaaagcgcgtcaccagccaagccagcaccaccccaaaaaccaggttcactggcacggttatcaatgccactaataccgtcagccagatggcgtgcaacatatctgggtttaataaattctgcccgaccaccgcaatgcctttagaaaacgcggtgataaagatccacaccatcgggatcaccagcagcaaaaacgagaacgccgcaccaatgacaatcagcgtccatttgccccaattgatcggtgggcgggcaacaccgttaaattcagaaacatccatcattagtgcccacctatccgccgaccaaagcggctttgtaacgtgttaatgctaaacaacagcgccagtgacacggccagaatcaccgaggcaatggcgctggctgccgggtaatcaaattcctgcaaacggatgaaaatcatcagcgaggtcacttccgttttccaggcaatattaccggcgataaagataaccgcaccaaactcccccaagctgcgggtaaaggataatgcggtcccggccaatagcgcgggtgccaattccggcatcaccaccagacggaagctttgccagcggctcgctcccagagtttctgcggcttcttcgtactctggccccaactcttccaataccggttgcaccgtgcggaccacgaacgggatgctggtgaaagccatggcgaccgcaatccccaaccaagtaaaggagactttgataccgaattcatttaaccaagcaccgtaccaacccgtggtggagaacagtgtggccagcgtcaggccagccactgcggttggtaacgcgaagggtaaatccattaacccatccagaatgctgcggccggggaattgatagcgggtcaaaatccaagccatcaacatcccaaacaccgcattgaacacactggccacaccggcggccaataacgtcactttatacgcggcaaccacttgagggttggtaatcacctcccagtactgcgcccaactcatctgcgcaacttgcatcactaacgcgctaagcggtaatagcaaaatcaagcaggtataaagcaggctactcccaagactgagggtaaatccgggcaagacccgtttactggatgccgacaacattactgatgcccttctgctaacaatttatccagtacgccgccagtagtaaaatgggtactcatcacctgtggccagctaccgaattgatcttcaactcggaataatttggtgtctgggaattgagatttcgccgcctccattgccgctttatcgtaaacacggtaattgaagcgagtgatcacctgctgtgctggcgggctatagagataattgagataagctttggctgctttttcagtgccattcttttctacatttttatccacccaggcaaccgggaactcagccaaaatatccactggcgggacaataacttcgtattggtcgctgccgtactctttgcgaatattgttaacttccgattcgaaactgatcagtacatcacccaagccacgttcaacgaatgtcgtggttgccccacggccaccggtatcaaacacttcaacatttttcaaaaagcgtttcatccagtcgcgggttttcgcctcatcgccgccatcggccagttgggtcgctccccaagcagccagataggtatagcggccattaccggaggttttaggattagggaaaaccagcttgacgtcttcgcggaccaaatcatcccaattgcggatattttttggattgcctttgcggaccaggaacgccatggtggagtagaacggtgagctgttattcggcaaacgggcttgccaatcggctgggatcaaattgccacggtcatgaaggatttgcacatcagtaatctggttgtaggtgaccacatcggctttcaggccttgtaagatagccaatgcctgcttggaagaacccgcatgggattgtttgatagtcagtttgtcaccggggttctgctgttcccactgtgcctgaaaacccggattcagcgccgtgaataattcacgggaaacatcataagagctattgagcaactcagtggctgaggcagtgacaccactgagtatcagcgcactaaataatgcaatgtgggtcaatccgttacgcgcattttttttgactgagttctgtttcattccgcaccttgtccactgagttcaaccaataggcatgtcattcattatgaacggtgtgcctttaaattatgttcagtgtatttataactaggcgtatacctataacgcttttatataccgtttagtgatggtcaagcatgaaatgctctaagccagcaaccccgctgctcaccagcgactctggttaatggtcctctgcgctatttaggcggggttatcgacactaaaaaaacaaataaaaaaaagcccggtcgtcgcgcaccgggcaagaaaaacagtttatggatgaaaaataaatgatggatgaaaagtaaattctggctgaaaaaacgttatttctgtgtcactactcgcgcatgctgggccgtaatggcaccactgaatggtttgccatcgatggcatccaccatccgtaaacctgatgggcggacccaacgctgtacacgggatggcatatcaaaaccaatcagtaggatcaccacgaatgtcagactgaaagagagcgatcccaacgcggtgcctaaactgagatgttgagcaatcgatgcccccagtatgggtgccaatgcccctcccaatgcgccgacgttgtaggtaaagcccagtcctgcggctcgctgttcggtatcaaaataaccgcccagcagtttcggcaacaggcccgcaatcccctgccccagcatctgttgtaagaacagtaatccccccaggaacaaaatactgctgccttggatggcaaacagcgggatgatcaagagctgtgatatcagcaaactggtcacataggctttgcgggtacccaaccaatcgccaaggaaaccgccaacacaacaacccacggccgcaccaaaaccactgaagaacaatatattgcctacggtgtgtgggtcatagccgagatccattttcaggtaggtcggtaacaacgcctggatcggccaagaatagaggaacgcacagaacaccacgaccatcagcatgacgcccgtaggccagcgatcgccactggtttgaaccataaaatagataaatattgcagcgcaaagaataccgagaaccaccaccagcaacgtcgagaccataccagtaaaacagaggtaaagtgagacggcggcaaatatcgtcaggccaatattcagataactgaggtgactgcgatacagaatatccaccatattccggtcagtgacctgtttaccttttttctgcttactttgtgccttttcccagtcctctgcttccggtaggtttttacgcaaccacagtgcaaagataattggcaataatccaatgtagaacaacatacgccaaccaaatgcgggcaccacgtagctgtaggcttgcgccgcgagtaccgcaccgatagagaagccagaaatcaggaagccactggctttattacgcatgtttttaggccagctttccatcacataggtcgagctggaaccatactcacccgccatgccaataccaataatcaagcgagcaataaacagcgtggtgtagccaggtgctaagccacaggccaacgtaccgaaggagaacaacacaatactggtgatcatggccagtttacggccatagcgatcccccatcgcacccagtaccaacccaccaaaccagcgtgagatgaaggcagcagaaatcaggctggtcgcctgaatcagtgtcaggccaaattcttgtttaatatcggtcagaaccagagtaatcagaacaaagtcaaagccatccagggcataaccgatccaagcggcaacaaaggccttccattgcgccggggtaagttgtttgtaccaacggggtggtttagcgccacccgataatggtttatcttcacgagatggacctactgaaatactcatatcatcgctctctcttccccactggcaatgatggcaccagcagtaacggttttccccgaggcatgtacaaccatagcatgtgattgtttataatcactttattgattgctaatcgatgtttattgccatgttggtctttatgcgccttttactccaaatagcatttaataaaggagtaaaactccatttgagtgtataagatcagcccgccatttcaatagcaatatgtctaaaacgtgacaaagacagcgaaatgctgataagagaaagagaagcaatgggattaccaggcgtttactgccactgacaggatatcaccgcagaaaataaaaaaagcacagcagaaagtctataccttaaacaattcgagttgcgggaaggcggcaagtgagcaacaaattgatcggcaaccgattggaactgcatttatgctagcccacagagtgagactctcgcgcttacaccagtcagtgactgaggtgacaaatctgccgggagcagatatgaacgcggcttgcagcggagaggcgaggcccatggacgggccgagtcaccaaggccgcctacgcacatgcagcttgacgtatggcgggtagattaccggtcatccattttggctaaccgcttgggttgttttgcgtttaatactctccgcctgcgccggatcagctttgaccaataaggcgtaaatcagatccaacacaaacaattgtgcgatttttgtaccgatggagtccccctgcaattgcccctgccggttaccattgatcaggacataatcggctaattcagtgatccgtgaccccatattatgcgtcaacgccactgtcgtcgcccctgcctcttttgccaatttgagggcctgcacagtttcagccgaggtccccgaatgactgataccaatggcaacatcaccagggttcataagagaggcttgcatatacatgaagtgattatttgtcgcagcatcaacccgcaggccgatgcgcattagtttgcctttggcatcttccgcagtgatccccgaggagccaacaccaaaaatacagatgcgatccgcagggcgcagcaatttgaccacttgttcaacactctcaatagaaagcaaattaagtgtttcagataaaacattattgatagcggattgtaatttgctgccgatcgccagcgtatcgtcaccctcttggacatcggcatctaacaggctgttttcactgttatggcgggtggccacttcaatggccaggtccattttgaaatcctgaaaccctttataacccagtgtccgacagaaacgaataatggtcgcttcaccggcctgtgtgagtgccgagagatcagcaatagataattgggtaacctgagccggttgcgccaaaatatacgcagcaatacgctgagcagaacgagtcaggctattttgcatcgcacccaaggcatcaagaattttacctggcttaaagcggggagcaccagttttcacgcggacacctcaagggaaataaaatgacagacaggatgatatatttgaggcgcatcattacatagttgacctgtttcgtgaagatcaatggtggaggtgtacgggataagatcaataaaaaaaacccggaaaaccgggtaaaaaggtcaaaaacgctgtttttcttatgatataaaatcagaaagataactagctattcaaaagactataatgaaccttcacgaccacctttttgatagcaccagaaccggttatctggcagcctggcttatgtggctctcccggtaaaaataccgcaaacatgccgggcaacatacgtaactggcttttatctggaatatcggcgatgagctgataatcatcatcagggtgataaggctccagatgttctgtcggtgtcagggtcgaatactcaatcccctcaatgccgctgatcagtaattgcacatcggcgtaggtacgatgcagctctgctttcttactctctgcgggttgagtgtcaaacgccatgacattcataaacatcaactcaccgtctatctcatgccgcccgcagcttaactgcgctaaaggcatatccgccagataagctaatacccattgaagacgttcaggtaagccactaaaaaacgccggttgtgccaaggatccactgatcatgttatgcctcgatattgactgatgacggtatatttactgataacggtaagtgactcaataacggtatatcactgatcgtgatcacaacgacgttctggcccacagtgccgccccgagtaatccactatcctgacggtgatgtgcctcttgtacggggacgcggtaaatacccggtaatgtcttctgggcggcaaccaccctctccagatagccgaccgccaacccgacactgccccccagaataaccacctccagatccagcgccatcttcatgtcagccaacatctgagcaatggctgccgcagaacggttaatgacttttcccgcctgcgcatccccttgctgcgccatgtcaaacaccgtggcagccgataccggttgcttccaccccaaggtttctgccccaatagccgtgcctgatgccacgctctcgacacatccccggcgaccgcaaccacacaaaacaccatgaggatcagacagcgtatggccgatatgccctgccagcccacgttgcccgaccaacagttttttattcaaaatgatgccgccgcccacaccagtggaaacggtcacaaacatcatattgtcatttttatcacccagcgcctggtattcagcccatgccgcagcctgaccgtcgttcagcaggacacaaggcagatcactgatagagcgaatacagtcgtacaatgggaagtcagccagaccgcccaaattggccggattgagcgccgtcagacggcccccgctgataatgcccgttgacgcaacagcaataaaatcaacctgatggcggtaaggcgctatcagtgtttccagtgcggcagccagttgtccggcaccgcctcgtggtgttgctatttgctggcggccaatcaacatgccactctcagtgaccaccgcggcggcaatttttgttccaccgatatccagtgctaacccttttcccatctggcgtaaccctcttgtatcttaacgagtctactcacgctgaatggataactatgccaatcttttagcgcaaactccattgttatttttagtttggagttaaactcctttcgggggatttggttgggctaacgaatataccctaaacactcactgggtcatcagataagaaaaacttaaaaaataatttaatatcagttttttcccttatacaggaagccgtatttatcaagcagtatgcccctgttaaaataaggagcttactgttatgggtttaaattgttttggtatcagtttttcatcaccgaatattactttagatagtgattctactcaccagaaattgtcaaaatctgactatcacgctatatggaaaaaatgggagaacgctgcgattcccggcgaaggggaacagcgtgatatggccgtagaggcaatgaaaatccatttaaaaaataaaaatgccaccgaactcaacctcaacaatcttggtttacgctcattgcccgatattttacctccttgtacaaaactgaacgtctcaaataattatctaactgaactgccgctgttgccagctaatctgacacatctcaatttagccaataatcaattgactaatatctccggccattttccactgcccgataatttgacacacctcaatttagccaataatcaattaactaatatctccagccattttccactgctgggtaatttgacacacctcgacttagccaataatcaattggtagaacttcctatgcattttctaacacagttagacaggttagaaaaatttaccgttgcgtacaataaattaaccgaactccctgagctccctaataccttagagtcactaaatgcagataataatcagctacactgcttgccagaaaaattgccaacatctctgcgtttaatcacagcaagtaacaaccaaatcacccagttacctgaagctatttttgatttatttagtgacagtaaaatcgtactgaagaataatccactaactgaaaagacgtattattttccatatggttccattgtgccaaatatattaatgtccccctcatgcctaacaaaacttaaatattcatcctatgaaccactcagtgagatcgtaaaacactggctgacaccagagcaacaacaatttttagaaaaaaaatggttagaaatagaaaaagatccagaatcagaaggattcacaaaatatcttaaccaactcattaacataccaaaattagtacacaagccaagaccaaatccccagctacatgttcgagatattagtgatttttctaaacagaagatgaaaaaaacattattagacatagtaaattcctgttccctgcgtcaggcgatatttttaaaatataacactaaaccaaatttataagttaacaccctgtcccccatcagcgataactcagtggtggggacagggtaacctatagccagactcaagcgcttacggcgatattactgctgaatcacggctgatttatccgctctgatacccgagatctcttcctttccatctgctaccgcaaaaatttggccgtttcgtcatacatcgcccttcttatcgttgcacccgacggataaacgatctaacataatggagttaaacttcatttataatttcacatcggagttaaagaccgtgagcaatctaagcaatctccgccacaagctccaaaatggccttatcgcctcatgtcaaccggttcccggcagtgccatggatacgcctgagatcgtcgcggcaatggcctgtgccgcactggcgggcggtgctgtcggtctacgaattgaaggcatcagcaacatccaggcagtacgtcgggctacagatgcccccattattggcattattaaacgcgacttgcctgactccgaggtcagaattaccccttggctggaagatatcgatgcactcagtgccgccggagcagatattattgcttttgatgttacctgccgtgagcgcccagtctccgtggccgatttatatcagcgagcgcgggcaaccggctgcctgaccatggccgatgcctccaatattgacgacggcctgttggctcatcatctggggattgattttatcggcaccaccctttccggctacactcaagccatcgtgccaaccgagcccgatctggccttagtgacacagttagcgcaagccgggtgcagggtcattgccgaaggccgttaccattcaccggccctggcggcagcagcaatatccgcaggggcatatgccgttacggtcggttccgccattacccgtatagaacatatttgcggttggttttgcgatgcaattaagcagtgtgaaacagaaaaactgaccgaatactgattatcgtcattattgattatggcccacagggccctccactctcccagtttataaggatgcgtatgaaaaagttaaccggcctgatcgcagctccgcacactccctttgatgaacagggcgaggtcaattatccggtcattgaccaaattgccgagcatctgatcaatgatggcgtgaaaggcgtttatgtctgtggtaccactggcgaaggcattcattgctcagttgatgagcgcaagaaaattgctgaacgctgggtaaacgccgctcaaggcaaactgagcattaccttacacaccggtgctctcagtattaaagatgcggttgatctctctcgtcatgcggaaacactggatatcttcgcaacctcagccatcggcccctgtttctttaaaccgggtaatctggatgacctaatcgcttattgtcaggcaatagccgcggcagcaccgtcgaagggcttctattactaccactccggtatgtccggtgtaaatttggacatggaacagtttctgatcaaagcggaatccaagatccctaacttgtcaggaattaaattcaataacgctgatttgtatgagtttcaacgctgtttacgtgtgagtggcggtaaatttgatattccgtttggcgttgatgaacatctgccaggtggattagctgtaggggctattggcgctgttggcagcacttataactatgccgctccgctgttccataaaattatcgctgactttaatgcgggtgatcaggttgcggtacagcgtggaatggatcacgttatcgccctgatccgtgtgctggtcgaattcggtggtgttgccgccggtaaggccgcgatgcaattacatggtattgatgccggtaacccacgtctgccactgcgtgccttgaccaaagaacagaagcaaaccgtggttaacagaatgcgtgacgctattacgttgcagtaattatttctctctcttccctaagtgataaataatgaaaggccggatttcatcaatccggccaacggtgatatattttgctcgatacctcatccccgatttacagcgacaataaggccgtcagtgagggggcaaaataatagctgccggtaaccggtttgctaaaacgcagcaactgatcgtgcttaccatctatatcaccaaacatgctcaacaattgctgttcgatattatgtaagcgcgcgcaataggcgataaaatacagcccatgtttaccactggcgagaccataaggcaggctttggcgcagaattttcaggcccttgccattttctttcagatcaacacggctgacatgagaggtctccgggcgctgatctgatggcaactcctggctgtcgagtttggtgcggccaataattttctcttgctcattttcaggaatgcgctgccatttgttcaggttatgctcatagcgctgaaccagcacataactgccacccgcatcctcttcgccatcggcaatcacggccacttccgggcgcttatcgccttgtgggttctcggtaccgtcgataaagccggtaaaatcacgctcctcaacccaacggaaaccatgtgtctcttcttcaaccgcaatcgcgctaccaaaagccgctaccgcagcttgtgccaacgtaaagttaatatcctgacgcagtgactgaatatgaatcagcaggtcacgctgagtggcgggagccaagcctttacccaatggaacaaaaggttttagctcttttgcgccctgtccattggataagtcgtgccagacattggagccaaaggcgatcactgcacctaaatgctcatctggaaattgttgctgtaactcttgcaatgattgacagaattttttgcatcctaggcgaatagcatctaactccccctgtacttttgcttccataaaaatggcaaaacgacagtgctccaacagaatgccactctgaacttgagtcatgcttttcttcctcactaaaacctcagtattggttacgctgaatatcatagctgaaacgattaaaattaccttgcgacaacgcaaaataaagcgggaagagagagtaatgcaaggataggaataatattaaggcgctgaggtagcgcccaagtgataatagcaaaatgcaattaattcttattcgctttttgcacgccaaataatcttactcaccgtccaactttgcaaagcatcgtctgatggcattaactcttcagggccatgccagttgccattaaataaatagctgacgtgtttactctccggtgctacgcactctacttggttgacatcatcaccacggcctttatggcaggcaccaaatgcttttttgtacaaatcactgaatggcgttccgatggtaaccccccattggctggggatccctttatccatgacatcaatacgttctacctgccctttaggctggccggagataaccagttttatctgatcctctttcagcgcctgatagaaagaaacaagttttccatcgttggtggccatgccgctacgtaaacggtaatcgccttgcaacccagcgttgatatcactctccgtcaacagtgtactggcagtgatgcccccgaccccctgctcagtcacctgcatactgcgactaccgctaaaccagttaagtggcgataaacttgaccaagagaaaccagacaccgttgaacacccggccaacaacaagggggcactcagtaatagcaaacgcaccccagacaaccttgggcgaatattcatctcatgctccttaaaaataaccccgacatcccatcagcgtttctgcaactcaaagcacacagaagcccaatatgaatcgctaaaaagtgataaccagtggtttgagtgcgagccagtagaaaagtgccattatcttgttgccttaataaccataacaagtaaaacaccatcattaatcgacttttttcctaaaaaatccactgtgtcactattgataaaatctacgtcaatccctattaaccagtcaaatagtgatgttccagaaacgcttattacgattttagtctattattgagtaccaaagaggcctatacgggtttctggcctcagacgaattattcattcattgaaggagcaataagatgaaaaaattaaccctggcagcaacgctcattatgctatgtggcaccccagtgctggcccaaagcgctagcaacaccacacaaggcggctttgacggcccggcaaccacgcaaactcaacccgctacccaggggggattcactggcccgagcgcctccagcaccacagtagataaagtcaaaaccatgcgtgatgacgcccgtgtcaccctgcaagggtacatcgaagcacgtttgggccacgatacttacaccttccgtgatagcaccggtacgattactgttgaaattgacgacaaacgttggagaggccaaaccattacgccacaagataaagtgcaaattgaaggaaaagtagataaagactggaactcagtggaaatcgatgtgaaaaatatcaccaagattaaataattaatttccccattccctactctcattgaccgtttatcggtgctgagagtaggattaaccctatttcatcgcccctataacctcttttattcttgatgtagtactattatcaaataccctgcctgtatcaaacataatacctgcatcaacataatatctgcatcaacaccatacttaaaaaaaatatccctcatcaccatgattttgatcagtttttatcgaaataatcgcagaaacacataatttaaaaacccaaccaggataaattttaggttaatacaagatttttcctacaacaatccgcatgcgttcccatatttcaccctgcttgattttgttaaaatccttataagaagaaaatagaaataaaaatttaatggtttactctccattaagacaattaattaatcatcattaatgagcaatgtaaaatcacagcgtatcaatgtggaatacgtaaatttaatgaaattaaaaaataaattggagtattattacattgaacaccaatagtaaaaaaacctaccttagcattgctatttcatccattctttacgcctcaacagcaatgaacgcaaacgccgattcatgtactgattatactgtcactgatatttgtgagcagagtaaatatggtgcgggtgaatttcataatattaagctgggtgatggtgtcactgctggtagcgaagatcaccattttgtctttaatggtgaaggatatgaattatacaattctaacgcgaatttctctgctcaaattgcctcaggtaccattcgctataccgaagtgaacaacagtcactttactgtaaacgctcaccattttccggatgataccatctatgccggccgtgcagaaaataccacattgaatgatagcctgatgtgggtggcaacatcggctgatcagacactggctaaaggtaattcaatggtcgttgtttccacccaaatggccatggttgatcaaatttttgttacgacgttgaatgatggtagccttccatttgatcccgtcattaccaatagccgctatgaagatacgtcatatgaaatgttatggggtatgaaaaacgaggcaaaagggtgggataccaaagccacatcgcatgactccgtatttgttgatgccagcaagcagtctatcgaagccaatggtcacagtattggtgccacattttatggtagggccactcaggtggtcaaagctggcggtgagtcacaggatacccacttatttgatcacagttattcctgggtatatgccgaggctaaattaaccggtctgacggaggttaatgacgctgccactgtctatctgaatgccgcagcaactcaaggtgcttacgctgagaatgtcgttctcaacggcgaagatacaacattgatggtgcgcgcgagtctggataacaatgcctatgccacggtggataacctaatattgaatggcggtgaagtggttttccagcagagctctggcgaccaatatgcttcattaaacatcggcacactttccggctcgggctccttcctattcaatacctctattgctgaggggaaaggaaacttcgtgactatcgccaatgccagtggggaacataaggtgatagttaacgactctggccatgagatcacctcacctgatatgaccacattggacttgattcacgatctcagtggtgatgcaacattcacactggcctctatttctggagctaacatcattgaagtcgatggcggcacttacgtatatagcttgaatacctgggataattccgcacgagctggcggaaatctgtggtatttaggctcaggtttgaatacaggcactgagcttgaacccgaacctgaagagaaaacaaccccgtcaacggatgcggtgttgagtatggcctcatccaaccagtttattttcgatggtgaaatgcaaaatctgcgttttcgtaaaggggatttaaataataataaaggtgatggcgccagtgtttgggggcgttatttaaccaacaatactcgggtcaatgctgctcatgatgccgcttaccgtttgcagcaagatggctttgaaattggtgctgataaagtgctggaaatgtcttcaggccaattagtcttgggcggttttacctcttatagcaataaccgagtgaaacatgctcgtggtgggaacagtacggttgatagttatagcttgggtgcctacggcacttatttcgataacagtggttattatgtcgatgccgtcgttaaagccaaccgttttaaaaactcactgaatgcccatatgaccaacggcggttcggtacaaagtgattataaccagaatgcaatcggtggctcactggaagccggttatcactacagcctgtctaataattggttcgtagagccttatgttcgcaccagctattacacggcacaggataaagatattgcgctgaataatggcatgacagcgaatattgataataaccgctcagctaaaggtgaaataggtacacatctgggaacgaagattgacctgaataatggggctatcatccgcccttatgccaaagtcgctattgaacgagagttcatcaaatcaaataccgtgacgatcaatcaggttaacgactttaataatgatttatcaggacataccgcgaagtatggtttaggcatggatatcaacctgacgaaacagacttccgtttatgccgaagccaattaccgcaacgggactcatgtggagtcacctatcatggctaatatcggtttccggattaatttctaaagaacataccagatgagtggtttcccgcgataatgcgggagaccatttttttgctcaatagattaaacatgtctacccacgttacttcgagctacatcttcctggcaataagcaaagtgtaaatttttaaaccctcagaaataaaaaggaagaatagattagtcactaatatagtcataccgagtgcattgataactgtaggtatcaatgaaatagagtacacgccaaaaataagtctaaaaggctcttgtataaaagcagccattatcgctatctttttattttttaaaaagaagaaagcagtaaacaacactgaaatggtggttagcatcgaacctataacaataactctatatataagtagatcagaaaagtccatgggcagaaaattattaatatcactgacaaaggggattttaccgacagagaggctaacccatatatatctaacgatataatagagatccatcattccccagaaaataaagattttactttttaagttcataaatattatccaatgttactggcatcccgtgccatgatttccctgaaaccggccaaaaggcatcgccctcatcaataactacccaatgaccaggtccatactccgatgtctggggctgataatttcctgtatcggttgatttatccaaagggtctgatacaaaaaattgggtcgatattgtcttaaaatgcactgactaccgatacttaatccttactctgcactcttttatatctaactgtggcaagagtgtggcaaaaaagattttacttatctatgcgcatggataaattatggcaaataaggccttttaaaagagaaaaatagccgcaaacagaaaaatggcggttaaaaatcttgagataaggccaaaatcaccttttctatttctcggtcatttcagccagtggcgctatcgaatctaaagtgaatttaaaattaacactctttacattcaaccaactaaaccctcaatactcctgatccacaatcagccttttgcccagcataatcgtgtcttgggtttcgtaatcgagcttttcatacatgccaattaccgcgtcattatcttcgcgcaccataatattcagcttcgggcagccacgggcaatcaatttcttttccaggcggctgatcaatgcattggcaaagccaatttaagctctggtgcaaactggggttaagactatattttcaataaaaatcaaaacattatataaacaaagaattgcagaacacaaggttgaattgcagtattgtgcgttataagtgtggcgtaaataaagaaaacctccatactaataaatggtatatgtcacaaagttctcacaatcactttgtatatccagagttttttcctctgataaattaattcttagtacactagcatcgtcttcaagtttttcccaggcgatacgttcacctatatgctcagcccagtaaccatctgtagataaaataagctgttccatgtcggttatagggaattcattcagttcaggtgtatagaaacgtctggcatttagatagcgagtaagcgtaaaacgtgaatatgcatgagagtggcactgacaacctgctgccagtaattgcatctgttgttgatgtgtattatgtggtttaattaaccagtttatcgagggtgtatttttttggcttccaaataagcaatccccacaatgtagagtcgtcacaacttggagttctttatccaaaaaaacgacagcatagcttgcagtttcatgtaaatagttatggcgtaagtttttttgtttttctctcaaaatagcaacaatttcatttatatcgatctttaacattgaagtactatctatacgaaagttgcattcggctattactgcatttgcccaatattttgccaaatcagattcatgcgatgtattatttttctccgctgcatctactgctatcgcaataaatattttattattttcatacaaagccactgcgtcattatttttaaatcttttcaaacccttgcggctaacccatgttattagcataattatttaccaatttctattatcttctctagcctttcatagatctcatcttctcgcgctttatcaccatatgtatgactttgaattgcataatcgaagtcactcaatttaataaggacttcaatttgttgactaatatatatttttaaatcattttccgctgtagatatttcatttacaagctctggtcggccatcaactaaattgagaatatcttcaatatcgcgactttctagaggatcacctttcccacggccattgtatgcttccaatttagtagcaataaaataaacaggacttatcaaattaatacttagctcaggtgctaaattaaaataggtgcttgtttccattgcttttctataccatcggttagtaaaacctaatatattttcatcatctggcataaaatcgactcgcaaatcaccgagtttcattgcacaaatgggcgcaccatcgtcatcaggtacctcaattttaaatccatgcgcttgaagctcttgctgaagtgctgaataacttgtatagctcatgacatgcataatgagatcaacatcatcggtgtggcgtatttgttcccgagtaaactcatcggtgactaaaagacctgtcgtacaccctccgacaaaagtcatttttttacgtaaatcaggccctaatgcttcagcaacacgttggagcatatctaattgaatctcacgattaatcatcgagttacttccatccgtttcatcaacatatctgatgcaaaattacgttcacgcggttgcccaatacgtacaccatctatgagcgctaacaaagcatacatttcaggatctcgtcgaaccgcataagttgctgttttaaatagaggctcaaccgactggcccttggtattgcctttcgcatcaggccaaacaggtatgacatctcccgcacccatcagctttccttgcagtaccggagcaccaattgatgttgcaatgcctcgagtcaattctcctattctggttgggaatatgtatctcagtccatatataatgagttcgaaaagtgctttaacattggtacgtggtacacctaattttctgtcccgctttaccagacccacggagatcatatcttgtagagataggcttacctgacttttacttatccccgtttccgcagccaaagccctaacgctgtagcgctccacaagccagtcatcaatagaagtatcaggcgtcagtagattagctgtaggcgtatacaaatcctctgcggcttcccaatcccaccaaatattggaagctaacgcgaatgattcttgctgtttttttagtcgagcctcttgcttttgcaagcaaatgagctttagcatcaaaccgatatcttgacttttcatttttatcatccaattaccgtcccgtgtccaaggacgtaggacaatttattttacaattaactctagagtcaagtaataaatttatatcccatgagggagaatcggtggcacgaattagtagcaaaatttagtttgggtcaaatattagaacaaaattgtgccgtccagcccgtattttatgaggatgaagtcgatatcgatttgaatcccaaaatcagtgctgactggcagaaaaaaggtaaacaaaaacgtatccctagccggggaaaaatgaaaaacattaccttgcaggagccctgcatgcaggaacaggtagagtggactacgtcagcggagcaagtaagaattttggcctgtttatcaatatgttacgtaaactgaaaaggacatatcgccgtgcaaaaacaatcacattaatcgttgatgattacatcattcacaagagcaaaaaaacgttggaatggttgaagagtaatcctaaatttattgttatttattagcctgtttactctccgtgggtaaataaaatagagcttttatggctgtccttgcgcgaaaccgtcacgcgtaatcatcgctgtaaaacaatgtggcaattattaaataatgtcagacaatttatgaaagcggtgtcaccttttccgggcaacaaacagggactaacaaaagtgtagcggtattaagcgcagttatctaaaggggctgatacaaaaaattggggtcgatattgtcttaaaatgcactgactaccgatacttaatccttactctgcactcttttatatctaactgtggcaagagtgtggcaaataaggccttttaaaagagaaaaatagccgcaaacagaaaaatggcggttaaaaatcttgagataaggccaaaatcaccttttctatttctcggtcatttcagccagtggcgctatcgaatctaaagtgaatttaaaattaacactctttacattcaaccaactaaaccctcaatactcctgatccacaatcagccttttgcccagcataatcgtgtcttgggtttcgtaatcgagcttttcatacatgccaattaccgcgtcattatcttcgcgcaccataatattcagcttcgggcagccacgggcaatcaatttcttttccaggcggctgatcaatgcattggcaaagccacggccacggtaatctgggtgaacccccaaataataggcagagcctcggtgaccgtcatacccgcccatcactgagccgacaatcgtgccattcacttccgccaccaaaaataattcaggatcgtgatttaacttacgttcaatatccatttccggatcgttccaaggacgcagtaagtcacaatgctcccacagcagaatcacttcttcaaaatcgtcttgctgaaatatgcggatttccatggctgttcacaccgtcgagtaaaatggataggctgattatcgcgggaataggatatcacgcaataataaaatgatatttcccgcagcgatacccctttgtacttgaatagcgtcaaaggttactattcgcttacccacatcactcacattgggtagataaaaacgacgctcacccgttcaataaaagtaagcggccgcgcggatccatactggcagtacaaaaatagagggaaattggggtatacttagcgcctgaaaattgccaccagtgaacccctctgatgaactcacccgatatagccctaatcaaaacctacctgctcactttgcaggataacatctgtgcggccctggctcaggccgatggtcacgccgaattcacggaagagtgctgggtccgcgaagaaggtggcggtggccgcagccgggtcttggttaatggcgctgtattcgaacaagctggggttaacttctcccatgtgtccggggcgatgttacccgcctctgccactgctcaccggccagagttggcgggccgcagttttcaggcgctgggcgtgtcgctggttattcatccgctaaatccttatctgcctaccagccacgccaatgtgcggttctttattgctgagaaacccggtgaagacgccgtgtggtggtttggcggtggttttgatttaaccccgtactacggctttgaagaagatgccattcattggcatcaggtagcgcatagcctttgccaaccattcggcgagcaaatctatccgcgctataaaaaatggtgtgatgactatttttatattaaacatcgccaggaagcccgtggtattggcggcctgttttttgacgatctgaatagtcctgattttatgacctgctttaatttcacccaagccgttggcgatggcttcctggcggcttatatgccaatcgtcgcgcggcgtaaagccctgggctggggtgatcgagagcgtcaattccagctttatcgccggggccgctatgtcgagttcaatctggtctgggatcgcggtacgttgttcggcctgcaaacgggtgggcgcactgaatctattttgatgtccctgccgccgttggtgcgctgggaatataactatcagccagaggcagatagtgcagaagccgcgttgtaccgcgattttctgccggtaaaagactggttagcgattaaaggagaaacacactaatgcagatttgggtcgatgcggacgcctgtcccaatgtgattaaagaggtcttatttcgcgccgctgatcgtaccggcatgatggtgacattggtcgctaatcagccactgaaaaccccgccgtcgaaatttatccgcacagtgcaggtggcttccggttttgatgtggctgataacgagattgtgcagcgggtggaaaaaaatgatctggtgatcaccgcagatatcccactggcagcagaagtgattgaaaaaggggggattgccctaaaccctcgtggcgagcgttataccccagatactattcgtgagcggctgaacatgcgtgattttatggatactatgcgcgccagcggtattcagaccggtggcccaaataccttgaatcagcgtgaccgccagcaatttgccaatgagctggataagtggttgcagcaagcccgtaaccaagcaaaataagcacgaagagtgatggagactgcaacaccaagaagaggattactcaacgtcattggcgttgcagcaaggcagcaagcgagcgcatcccgatgagctgattcattttaaaatcaacgaccagtaagtgattcgggtaagtaagcgccgctaacacagctgcggcgtcaaggacgaagagtaatcgcctccactaccgccaacgccaccatattcacaatccgccgcaccgacgcaatcggtgtcagaatatggaccggtttcgttattcccatcaggaccgggcctacggtcaccccttctgacgacgtgacacgcaacaggttgtagctgatacgtgcagcctccatgttcggcataatcaagatattcgctgaacctttcagtgggctatctggcatcaggttatggcgaatactctccaccagtgccgcgtcaccgtgcatttcaccgtcaatttccaattccggtgccatctgattcaccagcgccagcgtctgacgcattttacgggccgccgggcaatctgatgtgccgaaactggaatgggacaacaacgccactttgggctcaataccaaaacggcgcacggtttcagctgccatcagagtaatttctgccagttgttccgccgtcggatcgttattgacataggtatcagcgataaaggtattgccgctcggcagcaacaaggcattcatcgccccagccacatgcgccccttcacggaagccaaacactttctcgaccacatcgtagtgttcgtgataggtaccgatggtgccacaaatcatcgcatcagcctcgccgcgatgaaccatgattgagccaatcagcgttggattaccaatcactgcacggcgggcctgttcctgcgaaacaccacgacgtttcatgatttgataatattcgtgccagtattcattaaagcgcggatcggactcattattgaccacttcaaaatctttcccggcactgatttgcaagcccaattttttcaaccgagtctcaattacgcttgggcggccaatcaagataggataagccagcccttgtgaaatcagctcttgcgtggcatgaagcacccgctcctcttccccttccgccagcacaacccgtttcatctctttcttcgcttgcgagaagattggcttcataaacaggttggttttgtagacaaactcagacagtttttcgacgtaagcattgaagtcagtgattgggcgagttgccactcctgacgccatcgccgctttggccactgcgggggcaatttttacgattaagcgcggatcgaagggtttaggaataatgtattccgggccgaaggagaggtcttgctccccgtaagcggaagccaccacatcactctgctcagccagcgccagatcagcaatagcatggacacaagccagcttcatctcttcattaatggtggtggcaccgacatccagcgcgccacggaagataaacgggaaacacagcacgttattaacctgattagggtaatccgagcggccagtacaaataattgcatcgggacgcaccgctttggctaacggcggtaggatttccggttccgggtttgccagggccagaatcaacggattcggtgccatggttttcaccatctctggcgttaaaacaccggggccagagcagccgaggaaaatatcgctacccggcatgacatcccccaatgtgcgctggccgttatcatcgatagcataggccgctttggtttcggccatattcgcttcacggcctttatagatgacacctttagaatcacatgcaatgatattgtgctgttttaaccccagcgccaccagcaagtttaagcaggcgatagaggccgcacctgcgccggagaccaccaatttcacatcgctgatatctttcttcacaacccgtaaaccgttcagtactgcggcggtgcagatgatcgccgtaccatgctgatcgtcatggaatactgggattttcatgcgttcacggagttttttctcaatataaaaacactctggcgctttgatatcttccagattgataccgccaaaggtgggttccaaagacgcaataatatcgatcagtttatctggatcgagttcatccacctcaatatcgaaaacatcaatgcctgagaatttcttaaacagaacgcctttaccttccatcacgggtttaccggccaatgcgccgatattacccagccccagcacggcggtaccgttagagataacggccactaaattgccacgggcagtgtatttgtaggcagctaaaggatctgcagcaatttccagacagggtgcagcaacgccgggagaatacgccagtgccaaatcccgttgggtcgccaacggtttggttggcgaaacctggattttccctggaacaggaaattgatgaaaatcaagcgcactctgtttcaattgttcgtccatcgtaggttccctttgtttttatgttcttatgcattgaagtgaagaggtatgaccaataacagaaccagtatagtgagtgatttatcacaatctatgaaccagcccatactctgcgtaacatttttattaactgacgttttattgatcaataagatataaaagcaggggaaaggcgattcgggtaaatgagcgcagctaacactgctgtggcatcaggatcgaagggatttcccaaagtcattggcgtcacagcaaggcagcaagcgaacgcatcccgatgagctgattcattttaaaatcaacgaccagtaagtgattcgggtaaatgagcgtagctaacaccgctgtggcatcaggatcgaagggatttcccaaagtcattggcgtcacagcaaggcagcaagcgaacgcatcccgatgagctgattcattttaaaatcaacgaccagtaagtgattcgggtaaatgagcgcagctaacactgctgtggcatcaggatcgaagggatttcccaaagtcattggcgtcacagcaaggcagcaagcgaacgcatcccgatgagctgattcattttaaaatcaacgaccagtaagtgattcgggtaaatgagcgcagctaacactgctgtggcatcaggatcgaagggatttcccaaagtcattggcgtcacagcaaggcagcaagcgaacgcatcccgatgagcttactccagtaagtgattcgggtaagtgagcgcagctaacaccgctgtggcgtcaaggacgaagggaaaaaatgaatctgcgcatactgcaacaacataatcgtcttaccatctttaattcgcccatccgcgaccatcgcgagagcatcgtggaacggcaattcgacgacttcaatgacctcgtcctctaccccaacctcatcggttatcttttgatctgggtgatattcagccgcaaagaaatagaccagctcagtcaccccccccggcgacatataagcctcgaacagcttttgtactttatcaacctgataacccgtctcttccatcgcttcacggcggatacacgcctctggcgaatcgttatccagtaaaccggcacacgcctccagcaacataccgctggcattgccgttaacataggttggcatccggaattgttcgatcaacaccaccgtgccctgttggcggttatacaacaagatagtcgcaccgttcccccggtcatagacttcacggatttgttgtaccgaggttccctcatctgtttttaaatcaaaggtgtatttgtgtaatttaaaccagttctttgataacaattcacactgtatattttcaattttgacagacatagactcttctttggccctgataatcattaacgtaatctagcatacacctcactgcgatactttttcctgctgcagtaaaaacgccctgccgacgcaaagtccacagggcgttaatcatcactctccgacgtatacccaaaatcgtgcggctaaccccccctcggcatcaaggagaagggcgtcctaaaaaccaataggtacatctttcatatccggcaacttatgggcaatccctttatggcaatcaatacaggttttaccttcggtaatggcttgactgtgcattttcgccgccaccgttttttgtgcgctgaaatccatattatcgaaattatgacagttgcgacattcttgcgaatcattggctttcatccgcgcccactcactttctgccatcgtcaggcgatgagcgtcaaatttctgcggtgtatcaatcaaaccaaaggctttggcatacagctctttactggctttaatcttacgtaccattttaggcccccactcatggggtacgtggcaatcggggcaggttgctttcacgccactgcggttgctgtagtgaatggtactcatgtattcctcatagacgttatctttcatctcatggcaactgatacagaatttttcggtattcgccatttccatcccggtattaaaaccgccccagaagataatgccactgacaaaaccaatcagcagtaaggtaccgagtgccagacgacttggtctgcgccaccactgccataaccgacggataaaaccgggttttttagtctcgctcatcatgccctcgcttatcactcatctcggttactgaccaaagccaggtgctggctggaagctattaccaacaatcggtgccgcgtcggtttgtggcacatgacactgtaggcagaagtagcggcgcggcgatacttcgctggagactttgccatcacggtcataaaagtgacttgagctgacccggggtgcacccgtggtgatatagtgttcaaccccgtggcattgcaggcagcggttagtatttttactgacctgatagccatccacgctatgtgggatcatcggtggctggttaacatagttcagcgccatccgtttttgttgtttaggcattttcaccttcccttcggcggtgccagagacttcaggtgattgcgttaagtccatctcaacattgctggccgcattgaccccgcccatgaccatcaatattgccagtagcgatatcacccctgaaactctgcgctttactaacttaagcattgtgttattcattatttgctcccaaaagacaccgtttttttccttggcattcccggatgatggttatctgtaatcaatggttatctgtgaatcatcaggccactacccgttccagtttcactgcgcatttcttaaagtcagtttctttcgagagcggatcggtcgcgtctaaggtcaggttattgaccaactgtgcggcatcgaagaacggcatgtacaccagccctcgcggtgggcggttacggccacgggtttcaaccagagaaataacctcacctcggcgtgaaatcactttcactttgtcaccacggtgtaaaccacgcgctttggcatccaatggatgaatgaataacacggcctctgggaaagcacggtgcaattcaggtacccggcgggtcattgaaccggtgtgccaatgttccagcacccggccggtagagagccacaggtcatactcttgatccgggctttctgctgccggttcataaggcagggcaaaaatgaccgccttgccgtctggtttgccatagaagcgcacctcttcgcctttcggtacgaagggatcaaaaccttcacggtagcgccagagtgtttccttaccgtcaaccaccggccagcgcaggccgcgtacctgatgatatacatcgaaaggagccagatcatgagcgtgcccacgcccaaagctggcgtactcttcaaataatcctttctgtatgtagaaaccaaaatcgcgcgcttcgtcgttcaattgatcgtcagggatctcgctcagtgggtatttactgactacatcgttggcaaacagcacctcatataaatttttaccgcgatactcaggtttttgattcaccaactcagcgggccagacttcttcgacgttaaagcgtttggcgaactcgacgatttgccataaatccgatttagcctcccccggtgaggggacttgctgacgccagaattgagtacggcgttcagcattgccgtatgcgccctctttctcgacccacattgaggtcggtaaaatcaagtcagcagacagcgcactgatggtgggatagggatcggagaccacaataaagttgcgcggatcacgccagcccggcatacgctcttcattaatattcggtccggcctgcatgttgttgttgcacatcacccagtaggcgttgagggtgccgtctttcagcgcccgatcttgtgctaccgcatgtaaacccactttttccgggatggtccccgccggtaactgccatgtggtttcagcaatctgccgatgtttttcattcgtgaccaccatatctgcaggcaggcgatgggagaatgtccccacttcgcgggcggtgccacacgcggaaggctgccccgtcagggagaaaggccccgatcccggcgtggagatcttgccggttaacaggtgcaggttgtagcacatgttgttggcccacacgccgcgggtatgctggttaaagcccatggtccagtaagagaccaatttcacctttggatcagcatacaactgggccaacgactcaagctgatcttctggtacaccgctcattttggcggttttttctaacgtgtattcagcgacaaaggttttgaaatcctcaaaactcatcggttcagaagcatcgctgccgggattcttcgccgctttttccaacggatgggttggccgtaagccatagccgatatcggtcgcgccgcggcggaaattcacgtgttgagccaggaagtctttatcaacggcattattttgaatgatgtaattggcgatgtaattcatgatgaccagatcggtttgtggggtaaagacgatcgggttgtcggccaattcaaaactgcggtgttcgtaagtggagaggacggcaattctgacatgcgcattggtcaggcggcggctggtcatacgcgaccataataccgggtgcatttccgccatattggagccccagagcacgaaggcatcggcttcttcaatatcatcgtagcaccccatcggctcatccataccgaaggtacgcatgaatccaacaaccgaggacgccatacaatggcgggcattaggatcaaggttatttgagcggaacccccctttcagcaacttcaacgccgcgtagccttcccacacggtccattgcccggagccgaacataccgaccgcggtcgggcctttctcttttagcgcatttttgaatttcagttccatgatatcaaaggctttctcccagcttattggggtgaaatcgccttctttatcgtattgaccgtctttcatacgcagcagtggctgtgtcagccggtctttgccgtacatgatttttggcaggaaataacctttgatgcagttcagcccacggttaaccggtgagtccgggtcaccttgtgaggccacgatacggccattttgtgttcctaccagtacaccgcagccggtgccgcagaatcggcaaggtgctttatcccacttgatcgcattggttgtctcacccaccgctttagcgacagtaggtatggtcattccggcggcggcagccgcagcaacggccgcattcgctttcataaagtcccggcgactgagtttcatggcatttcctcaccttgcaaatcctgctggtgataaaccagcgatacagccagcacaccatccagattacgcgctgactcaatatgattcaggagcgtgtctgagcgcgctgcctgcataaccaccaccaacttgcccaaagcagggtcactggtgggtatttctgttcccgggatagcgagcaggtggtccataagctgcacaaaacgtgccggtttggcttgcagcaccaatccacaaacatgccattcgttatcgtccatcttcactccgggtaagggttaccgcctgcactggacaccccggcacacaagcgccgcagccggtacaggcaggaaggtctaattcaggttgagcaatgccgctcaagcgtgggcgaaatttaattgcacgggtttcacagctatcctggcaactgcgacattcaacctggtgataaggcaaacaacggtcagagatactggctttaatctgccaagccgtctgctctaccgaggtaaaaatggccgcctcgcacgcctggacacaggcctgacaaaagctgcactcagcacgttgaaaatctatttcggggaatccaccactgcccgcaatcaatacgccagtttcacaggcgctgacacaggcatggcaacgggtgcaacccgcaataaagtcaacctcagataccgaccagggaggccggataataatgttcgcttgtttaccggtttgccaaaaacccgtcagcaatttacgccgcgataaatcagtcatgccgatatccttaatatcttctggcgtgcccgcgcatgcgtatgcgtatataaatcgttcatttaaagcccaaacaggcagctaatgataataattcttatttatattattaaaataaattttcttggttcactctgtttaataccgaataatgagtaataaaataattactctttagagttatttgatggtagacattgcgcaagatcaattaatttagtgattatttaaagggttttgcccagttaaatcaatttgcgttatcacttaatatatataacgattcatttaacgggaataattaccaaaacaagacgatgctttgataattattttttagataatctatgctactaaatatattggtatctgggctatcgaatggcgtttctctgcggttggttgaaaatcgccaaccgataaaagtctttttaacgcaaaaaaattacagcggcaaatcagtgagactgcgatacactgagaatgcagttcaactcactataatggatgtcatagtcagcgaaataagctatcactatgtaaatcatcagtgttcagtatgactgaaagtgtagacactctttttaggttattttatacccaatatattgatgtgacatacgctaaataattcgagtggcaggaagacagccccctgcaacttgaagtatgacgggtatagtcaggtaagcgacgaaccttggcggtcaggtgagtaaaaaccgcgcgtagcactgcgacatcacgtagaaaggtataaatcttgccatcagtaacggcatattaagtacgttactgtgtgctttttgagttacagggagaattattcattatgacgaaaagtcacactattctgatcgttgacgaccatccgctcatgcgccgggggattaaacaattgctagggctagatagccgctttgatgtggttgctgaagcgaacaatggcagcgacgccattactgaagcggccaaatttcaaccagatgttattttgctcgatctgaatatgaaaggcatgtccgggctagatacgttaaaagccctgcgccataacggcagtgatgcacggatcattattttgacggtctccgatgcgcgtagtgatgtgtacgcgatgattgatgccggtgctgatggttatttactcaaagattgcgagccagaaatattactggagaatattcgccaggcagcgcgtggggaaaatgtcttcagcgacgaggtgatccagtatttatcatctcgtcatgaacaagtgaaccctttctctgaattgactgaacgtgaattagatgtcttgcaagaggtggctcgtgggatgtccaataaacaagttgctttcgaactgcacatttcagaagaaaccgtgaaagtacatatccgtaatttattgcgtaaattaaatgtgcgctcacgggttgccgcgacgattatgtatttggaaaataaaaaatactgacatccgttgtcactatttaatggccgctaaaataaaatcatggttttcttgtatccatcttttattcagtggcccccaactctccaactggtagtaacccgcattattacgcacaccatgctgcacaaaagtcagcgtaacccccagaccgggcagtgcctttaagacatcttgtaacgttcgccgtggccagccggttagcgtcatcaaacgtggtacgttgagcgcttcagcactgctgattagccaacaaagatagagacggcgggcgaatactgggttgagttccataacaagctcctggttaagtagcgactatcgccttcatacatgatgttgcggccaagtggcaagcgaacgcattttgacgagctggctcaggtcagtgatcttggtgagctgacgtcgcgaataccgccgccataccaatgacgttgagtctaatcagtttactcgatgccagaaaaataactcgtttatcatttcattctcttctcagtctgaataaactcggttttatcgagctttttacgtgatctcctttttttctccacgttttatcctacattcccgcgtagagtgcagggtagattctgctgcatctacctaacgcccttggcgtcacaacaaggctgcaagtgggcgagagccgctgcgacgtcaaggacgaagggtactcattttctgaataaaggttggcactacatggcaaattttttcatcgaccgcccgatttttgcctgggtattggcgataattttgtgtctcaccggcgcattggcaatctcgacactccctgtcgaacaatacccgaatttggcccccccgaatgtacgtatcagcgccagctaccccggagcctctgctcaaacactggaaaataccgttacccaagtgattgaacaaagcatgaccggcctggataacctgttgtatatgtcatcacaaagcagcaattcaggtagcgccagtgtcacgctcacgtttcaggcgggtactaaccctaacgaagcgatgcagcaggtacagaatcaactgcaatcagccatcaagaggctgccccaagacgtacaacaacaaggggtttccgtttcaaaatcgggtgataacaccttgatgatggtggcgtttgtctccactgacggcagtatggataaacaagatatctccgattatgtcgccagtaatctgcaagacccactcagcagaattgaaggggtcggcagcgtcgatgcctttggttcacaatatgcgatgcgtatttggctcgatccgaataagcttactaactatcagctgacaacgagtgatattgtcagtgcgattcaatcccagaatactcaggtcgccgtaggtcaattgggcggaacccccgccgttgataatcaggcattaaacgcgaccatcaatgcccaatcccagctacaaacacccgaagagtttcgggaaattacgctacgggtcaatcaggacggttcactggtcactctgggcgatgtcgcaaaaatagagctgggctccgagaagtacgattatctcagccgcttcaacggccaagccgcctcaggtatggggattaaactggcttccggggccaatgaattacaaaccgataaacgggtcaaagcccggcttgccgaattggcaccgttcttccctcacggtttagaagccaaaatcgcctacgaaaccacaccgtttgtacaagcgtccattaaggacgtggtgaaaacgctgctggaagccattctgttggttttcttggtcatgtatctctttttacagaacttccgcgcaaccttgatcccaacggttgccgtaccggtggtgctattgggcacctttgccgtgctatcggcatttggctttagtattaatacgttaaccatgtttgccattgttctggctatcgggctgttggtggatgacgccattgtggtggtggaaaacgtcgaacgggtgatgagcgaagaagggctggatccgcgcgaggccacacgaaaatcgatggggcaaattcaaggcgcactgatcgggatagcgctggtactgtctgccgtatttatcccaatggccttctttggcggcaccaccggggctatctatcgtcagttctccattactatcgtttcagctatggtgctgtcggtattggtcgcgttgatcctgacaccggccatgtgtgccaccctacttaaacccattgcaccggggcatcatcacgctaaacgggggtttttcggttggtttaaccgcatgtttgaccgtaattctcaccgttacgaaagaggtgtcgcgcgcgtattgcatcacagcttgcgctacatgctgctgtatttactgttgctcggcgggctggccttgctattccttaaattacccacctctttcctgccattggaagaccgtggtgtctttatggctcaggtgcagcttccggttggatcaactcagcaacagacactgaaagtggttgagaaagttgagaattacttcctgacagaagagaaaaacaacgtattatccgtattcgctaccgtcggctctggccctggcggaaatgggcaaaacgtagcacgcctgtttattcgccttgccgactgggatcaacgcaccgccagcaccgattcctcattcgctattattgaacgagcgactaaagaactcagtaaaattgttgaagcgaaggtgtcggtcagtagcccgccagcaatttcaggtttaggtgggtcgtcaggtttcgatatggaattacaggaccatggcggccatggccatgataaattgatggccgcccgcaaccaattgttgcagatggcgtcgcaggaacccgcgttgacccgagtgcggcataacgggctggatgatagcccacagttgcagattgatattgatcaacgcaaagcgcaagcactgggcgtctctctgaatgacattaacagcacgctgaaaactgcctggggctcaacctatgtcaatgattttgttgaccgtggacgggtgaagaaggtgtatgttcaatcagaagccacggcccgtatgctgccggaagacgtcaacaaatggtatgtgcgcaataaaaatggcggcatggtgcctttctccgccttctctactacccgatgggaatatggctctccccgcctggagcgctacaacggctattcagcactggaaattgtcggtgaagcggcttctggagtcagtaccggtaccgcgatggatgtgatggaaaaactggtcagccaattgcccaatggctttggtttagagtggaccggcatgtcttatcaagagcgattgtccggctctcaggcacccgccctctatgctatctcgctactggtggtcttcctctgcctggctgcattgtatgagagctggtcaatcccattctccgtgatgctggtggtcccgttaggggtgataggtgctgttgcagccacttggatgcgtgggctggaaaatgatgtttacttccaagtcggtctattaaccatcattgggctctcggccaagaatgccattttgattgttgagtttgccaatgaactgaataaccgaggtaaggacctggtcgaggcaacactggaggcctctcgccagcgattacggcctattttgatgacctcgctggcctttatttttggtgtattgccgatggcaatcagccagggcgcgggttccggtagccaacatgcggtgggcaccggcgtaatgggcgggatgatctcagccactgtactggctattttctttgtgcccctgttctttgtcttggtacgtcgccgttttcccggcagaataataccgaacaaagagataaaccctaaatagttcaagttacaggaaggtagccaataataggcaacttgaagtaaagtcggttctcccctgcggcatgacgaaaaaaccatgccgctttattgcatcagattcactcttcataccctttttacttgaagtccctctgggattagctacgcatattcacctgaatcactgatttattggggttcatttgctggctgcaacgtcaaatactgggggtatattaaggacaaagaatggctaatatttatgagagaaatatccctgaacgtatagctacatttatccaatttgcagaaaagaacccggacttctccacaatattcatcgtgacgtcatccgatgatgaagggttaacttattggatagattcatatgatgaaaatggtgcagatcatcatatagccaaaagagacctcattcagttctgcgaggccgatatggggggcagtcatttttgtttttgggatgatgggcaagggaaatcgttagatgaaatgcctgttgtcgtcgccggaaatgaaggggatttcccgatagtggcccgcaattttgatgagctattaagcctgatgtctctaggtgaagagttatatcttcatggcgatgaggcatcatgttgtaattttgatggaagtacgcaagaacctgaattcttcgaatttctcaccttccttgaaaaaacactcaatattacgccactaaaaacagccgacgaaggaaatgctattattactcaagcaagattagcatttcttgatgaatttaatttatgggttaacaaagccttaaagggtgttgactcagagaaccaaaaataaaactcgccacaaaataaaccaataaatataacaatcgcgcaatactcactctagggcgtccccgccctactttctggctattttattgttctttcatctcagcatcataatataaagaaatatcctacaaaaaatgcaggtgagtctgattatcttcccctcaaaatcaacttataataaataaggttaattccaatgataaacgtgagtgggagttgagagaattaaatttttattccgaatttacttatcgaaacacgttaatgctttaggagcgattaatttataatgccaaccatcattacacatgcggctattcctttaaccctcggtcttggattagggacaaaaattattccaccccgcctattactggcaggaatagcgatttcgatgctacctgatgccgatgtattggcctttaaatttggcgtcgcctatggccatgctttcggccatcgtggatttacgcactccctgctatttgccttcgccttacccacgctactactggcgttctatcgattcttcaatacttcgcttacccgtatctggctatttttatttgtatcactgctctcgcacagcgtgctggattcgctgaccaccgggggtaaaggcgttggatggctatggccatggagtagcgagcgattctttttaccgtggcaagtcattaaagtcgcgccgtttcagctcgcgaaatacgcaacacctgcaggacatgcggtgataatttctgaactgctctgggtctggttacccgcgacactgttgatgttgttgttaatcctattaagaaagtcctttggcgcaaaaaccagtatgaggaattaaaatgcctgatatacagctcaggaacgcagaaagtcactatttcgtcatgccatgggctaccagggcgataatatttattcttcattattaacaattcattactggtgatgattacgtgtaattttttgcacaagatggtagtgatttaacgcgggtaataaaaaaggcagtgcctctacggttctgcctttttgcgaggattcctcccctggggataaaacaaatcactcattaaaaccagaatgatacttaacgctcacaataggtttatctggctatgccttacgcagcatcgcatcgataaacgctttccaaatatttaactcaacctcaaccataacatcctctctaataatcgcggttaattatacgcctgttttttgaacagtcaaaataatgagcaagctaattagaagagggatgattttactgatattgttgcctagagagccataatctgagttttgctcttcaaaaatggccctgagactgaaaaactgattcatcagaaaccgttagcgctgatgacttcagtaacaccagcgaatattatcccatgctgaagaggtcagccttagaccgtgttccggtacaaaactcaccaacgagaaggatgcctaaatttactggatttctggggtgggtgctgtttgtaacaataccaattagcttggaccccgtgttcgctcactaatacgccatcttttatattagtgagcctctatcttgtaggtcaatgaccataattaatgctgctgttgtgattttattccaccttcaatgtcatcgacgatacccatgatcttatccaatggaataccatttttttctaattcagccagcgcattcatataaggcaccataaccgagaagagtattttataccctgcgcaaaaataggatttcatcccatcgctgtcctgatcaatcctatgttttgggcaaccgccatagcaaatggctttatacatacacttacggcatgactcagatagcacctctttttgcgcggataatttatcgctcgccaacgaatccaatttatcgtggtaaatattgcctattttatactcagggtagacaaagtgatcacattcataaatgtcaccattggactccatcacaaaattatttttgcacgatttttggaaaacacagctcgtgtgcccattgccaataaatcggctgacaaaagactcaaactggcgaataaagagagttcctacatcatggcgaacccattctttgaagacctccgccatgaaatggccataatcaaccgcagggacagtgaactcaataagttcaaacgtgcttttttgatttgaaaaatcaatattaggctcggttgtttccaacagttcaataaattggatatgtttagcaccgatagattttaacgttcgataaacttcaagggggtattttacattgatacgatttatcacggttaatgtattgaactctacctgatgttttttgagttgctcaatacctgccatcactttatcaaacgatcctttgcctgagcgagtcacacggtagcgatcgtgtaactctttagggccatcaatagacacaccgactaaaaaatgattttctcttagaaagagacaccatgcatcatctaataaaataccgttagtttgtaaagcgttgtgtatttttttagtccctttatagcggttctgatactgtatcgctttctcaaagaaatccagcccagccatggtaggctcacccccttgccaagtgaaatacacatcatgccccgatgcactgatatatcgctcgataaatgtttcaagggtttcttcagtcatccaacctttgtgctgaaaaatgttttctttactgagataaaagcagtaatcacactttaaattacactggtagctggttggtttagccgtgatatgcatagttttcctcatggagatagacagacggcaagaaaaatacttgccgcctttggggcttaattcataccaagcgattgcttaattttattaaatttatcctgattaacttcactaacaggagattgactctgattaatgaagttcctcatctcggcttgcattaccttaacaacatcaggatgggtacttgcaaggtcttgtttttgatttaaatcactcagtttatacagatttaacttattaccttcataggtataggttaaagagtagtcattactgcggatggtataagagaattgactaagatcttcggtatttgggtttttaggatattcattggattcattacgcacaaatttatggtaaccatcccagaatggaatattctcttcatcgaaccagtgggtataggatgtcacccaggtaagatatttatgcggttcagctttgcttttccccgtcaaataaggaagtagtgagacaccatctaaattatttggagcatcaatctcagcggcttcaagcgctgtaggcatgaaatccattgcagagatcaacttgtcataatttcctgtttgcaatttccccttccaccaaataaacattggagtatgggttccgccaggaaatgtttggcttttataccctttctgattaccgttcaacggtaatggcccatcgataacggcaccgttatcagaggtaaacataattatcgtattgtcatattgaccattctttttaagctgctcaagaagccgttttacgccctggtcaacagaatagacagaggcatagaagttatcagcagtttggctacctgtattaaagtgtttctgatattcatccggcgctggattatcattaggtaaatggggagcactgtaagccaaatacatcatgaatggctcatctaaggatttagctctattggcaacaccgatagcctcatcggtaagttgatcactgatataacctttggctttcacccgctctttattatggaaaagagacggggaattataataagccgttcccgcggcatggtaacccataaaatactggaagcctcggttttgaggctgccattcatcggctgagtaagttgtaaagttatcgtggtaatcgcgcgtttgctccgcttcaggaacaggaacattactgatttttgaaagatgccattttccgatggccgccgtgtaatagccattgttttgcaataactcaggcaggaatgtctcttctaatgaaatcccattctgagcatcggtattggagtaaacaccaaaccttgcaggggaccggcccgtcataatggccgcccgcgaaggccctgatacgccatgagcaacgtagccattcgtcagacgaaccccttcatccatcaacgagagtagtgttggcgtggactttttggcggcttcaatggctttatcaatgcctattttgtaggtatcaacaacgtcccgatcttccatcgacttagggtcaaaggaggtcttatcaaaagggagctgcccataacctaagtcatccatggttaagacaatgatatttggcttattcttcgtgctgtattcttttggcgtaaaatcagcgaaagcaacattggtgtttgttgctttgagtttgacatcatcagcatatgcagggccacccatgacgcccgcagctaagatgaccgatatcgaagcactaataatgctcctgttaacctttaaattcatcatttttagttctctactggttatcgtccaattgatattttacgtctaaaaataagaattaatgtgatcggtctggtggattaaaaagatatgaatatcgcaaacaatacaactttaaatatcgttaaatatagatttcaggaactaaatatagatataaattaaatcgctacaattaccggaaccaaaaaaaaccaaatcaggaagataattctcttaaagaattattaaagccactgaaaaaacacaatgatgcgatattaaacggtgagaataagcaagaggagtgcgccagaaagggacaacaatgaaaaaacggtggcagctagcttatggtgtatagaaattgagtcagtcatttgtaacgaataacccatttgtaacgggtataccgcttgccagagcgttggcaaacggtatccaggtgcgataaatccttcccccgtacgataaaacagatcggccaataacctcaggtttttatagcttaggaaaaatccacagatgttcagtcggtaaggagagatgacaggactctttaccacgaacttcagggccataagcacggatcacaaaatcgtcagcgacggtgcggaacagatactcccagcggtctcccagatacatactggtcagcaacggtaattcaagctgattgccatccaggttatcccctaaacgaacccgctccacacggataaccgccgttccttcttgacctgcggtaaccccctcccccgcccatccccacaacccccaatctttaccttcgatacgcgccttaccatcacggacgtcgataatcttgccatgtaagcggttgttactgcccataaactcggcggtgaacaacgttgatggcgagccgtacatttcctgcggcgtcccctgctgttcaattttaccgttattaagcaataagatacggtcggatattgccatagcttcgttttgatcgtgggttaccatcagcgcggacaaaccgagattcatgatcagttcacgcagaaatactcgtgcttcttcgcgtaatttggcgtccagattcgataaaggttcatccaacaggataacgggcgggttgtagaccagcgcacggccaatagcgacccgttgttgttgccctcccgaaagttgatgggggtggcgattgccaagcgcccccagtccaagctgttcaagcaccgcttgtacgcgctggctgatttccgacgttgagattttgcgtaatttcagtggataggcaacgttctcagataccgttttatgtggccacagagcataagactggaatactaagcctagattgcgctcttcggcgggtatttcactacgggatgagccgtcataaaccgtcttttcaccaatgataatgtggccctgactcggtttctccagcccagcaaccgcacgcagtaaggtggttttaccgctccccgatggcccgagcagcgagacaacttcgccccgttttaattccatggacacccctttcaacacgggattgtcaccataggttaaatgcaggttatctaccgataattcaatcatgtaatttgactccaaaacgtagtgcaataccgaggcctaacaccaccagaaggatattgataaaggagagtgcggcgacgatatcaatggcacccgccgcccacaacgagaccagcatcgaacctatggtttccgtgcccggtgaaaggagataaacaccggtggaatattcacgctcaaaaatcaagaacatcagcaaccatgaaccaatcaggccatagcgggataacggaatagtgacatggcgggtaacctgaccacggcgggcaccagtactgcgcgcggcttcttccagctctggtccaacctgcaacagggtcgaggagatcaaccgcaggccatatgccatccataccacggtatacgccagccagacactgaagatggtgctgcgcaaggaacgtagccacaccaccagatggtcctgtaaccactcggtcatgggtaatgcggccagccaaccctctttcagggagttatccagccacataggcaagaacagaaagacccaaaggaatgccaacccagccaataaacccggtacggcacgcggcaccaatacactgtagtcgaggaagcgagtcaccccatcgggcttgcggtgcatcgcgataccaataaacagataacaaataacagccaacgccccaccgaacaccccgatagccatcgagttaacgatagcccgcagtagattcggctgttgccaaatggtgtagaacgtactgagggacagttcatcccaaagggacaccccaaccccccagttagacacaaaggcgcgcagcacgacccccaccaacggtacgccaatcgtcaccgtcaaccaaaatgccaccaccgcaccggcaacccaacgccatttgcccagtggcaaggcccgtgcctgtgaggctttgcctttgaccgtaacaaaacggtgagccgttcgcatcagcatgcgttgtaacatcacgagcggaatagtgatgcagatgagcaccacagcaaccgcagccatcaaatgataagatggcgtacccagtttattggtcaattgatagagataggtcgccagcaccaagtttccttccggatcacccagcaccaacatcaacccaaatacttctagccccaggaagaacaacaacacggtggcatagaggatcgatgggcgcaccattggcaaactgaccgcactcatcacctgtaatggcgaagcccctgccgtgcgggcagcttcttcaacatcagaaccgacgctgcgtagtgccgatgaaatatagagataggcatgaggaacatgggtcaggccagcgatcaccacgatgctagacatggcgtaaatattccagggtacgaaacccagtaaggattctgcccacaaagagaagaagcccacaggcccagccgccaccacataaccaaagcccaagaccatgggtgagacaaagataggcaccagaatcaacggttcaattatccgccggccaggtaagtcagtccttatcatcagaaaggccaggatccccccgagtggaatagcaatcaccactagccctgtcgccagaataaaaccacttttcagcgccttgtaaaaatcaggatcagaaaaaataaacctgaacgcatcaagactcagtacctttgaaggggagaaaaaaggagctgacaggaagctttgaataataataaatgatatcggtatgtagataaccagtgcggttatcaacacaactaagccgcgcggcaagctctgccattttctgcgcaatgctttcatagtgagccctgttggttaaagatccatgtatgatcaagccgataaaaccaaggactgcgcatgcccataaggcaagcgcacccagataaagccactattttgctgctgcggtacgccactgtttgatgtagtccaaacgtttagcctgttccatatattccaataggctctcatcaaccgggatgggtctcagcgcactgcccagttttttggtcagaccatcaatatcgttgttaccgtcaatatctttgcggatagaaggaatatctgactgattggccagaatattttggcctttctctgagagcagatagtcaacccacagcttggctgcattctggtggggagccttttggctgataaaggtcacccgcgatagcaccagtgtgtaatccttcgggtaggcgatcccaagagaagggtccgttttggcacgggtttcagcgtaagaaccgaggatgttaaaaccaatcagattttcaccggatgacacccgttccatcatcgtcccggtggaggattgcacggtcagaccacctttagcgatattagccagtgtcgtaaagtaattcggatccgccttgaaatcctgtaccgacaacatgaaccctaagcctgatttttcaatatcataggttgtgactttccttttgaatttatcaggctggctaacgatgagttttgccagtgcgatgtgggtatcaggcatatcggcctgtgggatcagacgcttgttatagataaagacaacgggttcgtaagtagagccgtaggctttgtttttccatattgcccatttcggcaactccgcctgctcaggggagagatattcgagcgcatagtcggtagccaacttgagtgcggtatccatggaggaactccacacaacatcgccactggtgctccccgatgcctgctcactgatgtagcggttgtataactccgtgctattcatatcgttgtattcaactttaatacccggataagccgcttcgaatcccttaatcaacggggctgccgccttaatatccgtcgcagaatagaccaccactttgccctctttttttgcaccatccacaatcttctgataatcggcggggtaatagcttggaagttgagcgaatgcaggaagagtggttaatgccgccatcgcgaacataaatactttaattttccttaacatatatttaacctctggtctcatttatgaaacgaaaaatcaacatatagttaatgtctattcctgcgcaacgaagttaattctttgtcttcctattttgtgatgtcgctcgttctttaaacttttctcttctaattctccctcactaaaatcctctacaaaggttagcttatggtataaaacggcactatttgtaaactatcccctcggcttaacttgccagtgacacatttccagagtagcgtgctccttatctaaagcagcaaaatctaaagcagcaaacagtttgctgataagccacggtgtgaaatgtatgaaacactccatcgactcgctaaaagagcttggccgctatggtgatgcactggcaatggcacaggatttactcagccgttcgccagataacgccagcttgctctataaaatagcctcactttatgatgtgcaagggttggagttgcaggcggttcccttttatcgcgccgctatcgaacataacctggtgggtacagaattgcaggctgcttatttggggctaggcagtacctaccgcacgctcgggttgtatcaagcagcgttagagacttttgatcacgctctggtccgttttccgcaagcaaaagagataacgttgttccgagtcatgacgctgtacaacctcagcgaaaccaaagaggccatcagtacgttattaatattactggctgacacatcacatcatcagaacaccagcctctatcagaaagctatccggcaatatgccgccgatctcgatcgtattggctaaatcctcaggctgcctctgtttatctctgtgctaaaccgcccactgtcatctggattcaaacacacttttcccgcattatgggctaattgctcccttggggctggccttcgcatgagtggctggcctgattttctcttttagccgaggtactatttttccatgtcagatcgccctgtaacgcccgcattgcgcctttatggcatcaaaaactgtgacaccataaaaaaggcccgccgctggttggaagaacaaggcattgcctatcagttccacgattaccgggctgatggcctcagtgacgaatgcctacagggctttatcgatacactgggttgggagccgttgctgaatacccgtggaaccacctggcgtaagctgccccctgagcaacgcgatgcaataaccgatgcccaaagtgccaaggcgctgatgctagcacagcctgccataatcaagcggccactgctggaaggcccgaatggtgagatgctgctaggcttcaaaattgaaagctatcaagaatttattcataaccaacccgctactgaggtgcaataacatgatctgtccggtaatcgaattggcccaacagttaattaaacgcccatcgctcagcccttcagatgcgggttgccaagagatcatgatccagcgcctagccgccatcggctttaccatcgaacccatgaattttggtgatacgcttaatttttgggcatggcgtggcgaaggcgaaacgctggcatttgctggtcacacggatgtggtgcctaccggtgacgagagccactggcacagcccaccgtttgaacccaccatccgtgacggcatgttgtatggccgaggtgccgcagacatgaaaggctcactggcagcaatgatcgtagcagccgagcgttttgtcgccgcgcaccctgaccacaaaggccgcctggcctttatgataacctccgatgaagaagccaaagccaccaacggtacagtaaaagtggttgaagccctgatggcacgccacgagcggctggattattgtctggtgggcgaaccatccagtactgaccgggttggcgatatcgtgaaaaatggccgccgtggttccatcactgctaacttgcgtattcatggggtgcaagggcacgtggcgtatcctcatctggcggataatcccgttcatcgtgctatgccagcgctgaatgaattggtcgccacccaatgggatgaaggcaatgcgtttttccctgccaccagtatgcaaattgccaatttacaggccggtacgggcagcaataatgttattcccggtgaattttatgtgcagtttaacttccgtttcagtactgaactgactgacagcctgatcaagcaacgggtagccgcattgctggatcgtcatcagcttgattacaccctggaatgggtattgtctggtcaacctttcctgaccgccaaaggggcgttggtggatgccgtggttaatgccgttaagcattacactgaaatcacaccgcaactgttaaccaccggggggacgtcagatggccgctttattgcgttaatgggggcgcaagtggttgagttggggccagttaatgccaccattcataaagttaatgaatgtgttagcgcggctgatttacaattgctcagccgtatgtaccagaaaatcatggaacaactgatcgcatgaccgataatacattaacgccgcagatgcttactggcctttcgacagatcatttggtggtgttaagtggcgctcatcgcctacagccacaggcggctgaggcttttcaagcaatgcaacaggccgctaaagttgcggggtttgatttacaacccgccagtacttttcgcgattttggccgccaattggctatttggaatggcaaatttcgcggtgagcggccagtattagatcaagacagccagccgatagatattttctcgttagataccgcagcccgttgtgaggcgatattgcgttggtccgctctgccgggaaccagccgccatcattggggtagcgacctggatatttacgatccatcgcggctaccaacgggtgaaaaactacagctagagccatgggaatacgatgcgggtggctatttctatccgctcacccaatggttaagtgcccatatggcagaatttggtttttaccgaccattcgctacagataatgggggcgtcgcggtggaaccctggcatttgagttaccgccctttggcagaacaagcggagcatttgctgacccccaagattctactggcggcttggcaatcacaagatgtggcgggcagtgaatggctggcaagtcatttgccgatgattttttcacgatttatctaccttaaatagtgcgagttgccggaaggcagacaacttgaaatatgacaggtattgccacaaccaaaggaatttaaccatgcaatggttagctgattactggtggatcattcttatcctgttagtgggaatgatattaaacggcattaaagagttacgccgtcttgatcataagcgttttttggacaataaaccggagctaccgccccaccgtgacaataatgcccagtgggatgatgaagatgactggccggatcaaaataagaaaaagtaagcaagccgcaaataatattccatgcggcgctaccgccttattcaccaattgacgatggcataatttataaccgtgacagtcccacgctcttgttcaagaagaggacctgcgtgggattgctctaggatacactgctcgattcgcctaagactggataaaccttccattgggcctttgtgcgaaaccgctaacgcaccgctggcattggcatatcgtaaggttttttctactggataaccggacagtgctacaccgcgccgatggtttggcagacatgatccattttatccacatcaatcattgccatcccctcggcggcttcctgacgccaaagtgccaccaatgccttacgccctgtcaaaccaagggtgttaataatctcagcctggggagtacgtaactgcaaatagtgtcgtaacgccgaaaggggtaactcggtgtgtaataacaaccgttgtagcgccggtaaactggcctctaatgggcggaaagcaaaagcaaacccagccagttcccgccaatcgtcgtcagttaacgtgacctccggcggttcaggtagccgtaaaaataccggggttggtatgtcaatccattgctgtaaccaataccaatcacgttttaactgctgctgcgccgcctgacagagtgcctcccccgcgggactaagaggtaacaacgccattgcggtataacaaccgctactggcctctttatggctaccaatacgtaccaaacgaaaaccacagcggtgccaaaaatgagccaactcggcggtatagccaaaactgaccgaaagaaaatcacactgctgctggcgggcatgggcctgttctgcggcaatcatccggcgggcaattccttgctgccgccatgctgccgtgacagcgacccggctgatacgccgcgataacagcgttggtgcctgccactgcccgctatgagcggccagtgattgtgccaccagattccctctgggccgccgccgacccgcccagacatcaagggccagtgcctcgctcaatcccccttcatccaccagccataatgcgccaatcacggcatcggccactctggcggcagagaaatgcatacccggagcatccatcaaacggcgtaaatccagcggcgtcgtgcggtaatgagccgtagagagtaagccataaaaacgccgcagtaactccgggttatctcgccaatcgcgttgttcataaagggtgatttcgatctgcgccgcaggtggccgctttggtaggggatgattgccgagtaattcatcatggaacaacatggcattatccatcactcgttccaagggatcatccgtggcccagcggataggatccgtcagcgtcaaatgatgccaatcgcccagtgtcgcgcagaatttcagtaaaaaaccacgccccgtgccctcatatccctgtaccgtggtggtcaataatgcccgggggaaatacgccaataatgccgataacagcggtgtcgggatcgccgccgcttcatcaatcaacaaccagtcaatatcactgacatcatgccgttggcaataatccaacagtgcgtctggtgcccaaaatctggcccgctcccctgcttgttgattaagcacttgagtggccgctttacccggcccggtcacccaacatgccccctgccagtgggtgactaacatcccggcaagtgtcgatttacctcgcccacgagcggctgtcagtacccaaataccgctatctgcctgcatcagacgctgaagaatatgctgttgctgtgcggttggtgaaccgtctggctgctgccaacatgggcgagaaccaaccgctggcaatatgagtggccgatcttgctgccacagcaccacatcgggatcagccaaaaactggcgctgtaagtggcggataaagttcgctgtgacaatcggagcgggttgctcactccagcgcaaactgtctttatctggccgctgcggccagtcatcccactcaggcaccagcaatagcagccaactccccgcccgcaaggtccccgcgacgatggctagcgcttctatatttaacccatcggttgcatcaaatacgccgtgtaagttttcctgccccaacagagttcttgccgctgttggactgatactgttgacgccttcgggaggctgctcgctcaaccatagccaatcgcctgccagatgctggcgtagcattattgcctgctgccgtgaccaatcggcctgaccactgaggatcagcaaacgcctgatcccctgctgcgccatctgtggttgactggcaacgattggattcgtcatcttacgacttgcctatgaccagtgagagcaaaccggcggcaatcaatggcccgacagggacgcctttgaacaaggcgacgccgagcaccgttcctaccagtagccccgccaccaccgacggttggtgcgtcatcaatgagacacctcgcccgccgagccacgataccgccacccccacgacaatggctaagatagatttccactgaacaaatgagtgcaatacctcgctggcgctgattttgccactggcaattggtgccattacgccgatagttaaaatcaagacaccgatggttaacccgtatttttccacccacgggaaaaatgagttcagtggcgtaatacgaatagcgatcaatattagaattgccaatgtcactgtcatgttatggctgaggatcccaagcgcggccagcgccaaaaggatcaataacgttggatcaagagcggccatgactttatccctgtattgcaatcaatgtcggcacaagcgtgccaatcagagaagaatagatcttatgattatcgattaacggatcagctaaacctagcgactagcaaacgtgttacagctattaggatcaccactgtcaaaaccacgcttaaaccaggtataacgttgctgagaggttccgtgagtgaagctatctggcacgacgcggccctggctttgctgttgtagccggtcatcgccaatggcctgtgccgcattgagcgcttcttgtaaatcccctgcttccaacacctgttgctcttccatcgctttgccccaaaccccggcaaaacagtcggcttgcagctccatttttaccgataagcgattaccttccgcctgagaaacgccctgctgttgctgacgaaccttcgcatcaatccccatcaaatgttgtacgtgatggccgacttcatgagcaataacatacgcctgagcaaaatcaccgcccgcacctaatttattcttcatatcttcatagaaagagagatcgatatagatggtgctatctgccgggcaataaaacggccccatgaccgactgaccggtaccacaaccggtctgggttgcaccacggtacatgaccagttttggatcctgataagtccggcccatcttctggaagataggtttccaggtatcttcagtatcggccaggatgaccgaggtgaatttagcatattggtcatcttgcgtactgacagctttaggagaacggggcggcgtctgggtttgtgacagtggatcaccgccatttaatagcggcgtcagatcaacgccgtagtagcccgcgaccaacacaataatcaggatagcgacccctcctttgccccttattgggggccggaacccaccgccaccaccggaagcattcccgcgacgatcttccacattattactttcacgacgaccttgccaacgcatagcacgactcccagacagattttctacgcgtatcgtaggaaatcgatggatcgaataccattaaaaatagcggtgattgatataactggtgggatttcactcaaatatagactgaatacaggtgacgctatggtgtcaagaatgacgagtttggggggagataaaggccaccgccccccgataacgctcacgacagagaaacgtaatcgattgcgctgttagtctaattttacgccgatacggtgcgcaacttcttcgtaggcttcaatcaaaccgcccaggctctggcgataacggtctttatccatcttgttcagggttttcttatcccacagacggctaccatcaggagagaattcatcccctaataccacttcaccgttaaacagaccgaactcaagtttgaaatccaccagaattaaaccggcatcatcaaacaatttgctcagcacatcattcgccaaatagctcagttctttcattcgggccaattgcgcttctgtcgcccaaccaaaggttttacagtaggactcattaaccatcgggtcatgcattgcgtcatttttcaaaaagaggtcaaacaacggtggattcagtgacaaaccttcttcgatccccagacgcttgactaaagaacctgcagcacggttacgaataacgcactcaaccgggatcatctccagttttttcaccagtacttcggtatctgacagcaggcgttccatttgggtaggaatacccgcctcttccaatttcgtcataatgaaatggttaaacttattattaaccatacctttacgatcgaactgctcaatgcgctgaccatccagtgctgacgtatcgttacggaactccaataccagtaggtcaggattttcggtggtatagacggttttcgccttcccacgatacaactcagctagcttttgcatcttattactccagtgatgtgaccattttagtcgtcatgaaataactaaaggggccgaagcccctttggttttattttatcgcggttgcgctagtctggctaaacgctgcctggaataccgcaaccaacgcatcattctgcgcctgggttaaggtatgccctttcggaccaatgaactgtaagctactgcggttatcaaggtcaccgacctgtaacttataatcgccttctggcaattcaggatctttggcacccagtgcgtcccagctactgctactcagcgatttactggtgacgctgacagtaccttgcggacggctgcggtcggtcactttcatgccaactttctcaagcgcagcaggcagacgttcccagacaaccgcataaggggcacggacaatcagcagaggcaagccagtatcgtcactgccactttgtacatccagcgtaccgactttacgtgaggcctgactgctctcgctgtcagcccgcactttatccaaaccttcgataatggcattcagcattgcgctgttatagcgctggatctcgctatactgagtgatggttttccccccttgttgtaactcaagggatttcactactaatgccagctgataaccttgctcctgcacacttatctggtaacggccttcgaactgtacatcttcatctgcccggttccatttgatccaatcagtggtcagcgtttggctggcatcctgacggctggctattggccagttatgatcttgcaggacacgagtaacctgagcccacagatcgcggttttgcgggctattctctaacaatagcttgctggtatcggtcgcattttcggcgcgggagccacttaacaatgtcagtggttgtaccggaggacgaatatccaactgttttcccacagcgccttgcgaattgacggtgcggacatcaaactcaccattttgtattggcaggatcatacctgatggtgcgttaagcggctttagtcctggcgctgtaagataagactcgtcaccactcacctggcgtttgtagcgttggtccgtcgagcaggcggccagtaacatcaccagcgaaacacctaccacttttaccacagtcgatttttgcaatgatattgccatcaaatttccctaagaagttacagcaaacctgcgcttttcaacgcgtcttccacaatccgtttggccggatcagtcagtggggtcattggcaggcgcatagtatcatttgccattaatcccaacctcttcgcggcccatttaaccggaattgggtttgcttctacaaataaatgctgatgcaacggcatcaagcgctgattcaaacggcgaccttcggcgaaatttccctgtgctgctaatgcgcacagttcaaccatttcacgggcagcgatatttgccgtcacagaaataacacctttaccacccagttgcataaagtccagtccactcgcatcatcaccactgagcaggatgaaatcttcatcatcaaccagcacttggatctgactaacccgacttaagttccctgtggcttctttaaccgcaacaatatttttaatcttcgctaagcgagcaatggttggcggtaacatatcgcaacccgtacgcgaaggcacattataaagaatttgtggcaaatcggtactttcagcgatcgctttaaaatgttggtataacccttcctgcattggccggttataatatggcgtcacggttaagcagcccacaacaccggtatcattaaaccgttgagtgagagaaatggcttcggaggtggaattggcccccgttccggcaatcaccgggatccggccaccagccagttcgagtgtctgcatgaccacatcgacatgctcatcatgattcaacgttgctgactcacccgtcgtccccacagagacgatcgccgcagtcccactggctacgtggtaatcaatcaggctcttcaggcttgcacgatcgacatcaccgttgtcgtccattggcgttattagcgcaactatgctgcctgtaaacattgggcttcccgtaaacattggctatcacctcctcaaacaagttcctcatggtacttttgacctctatccaaaagcaagtaaacaactgtgttgtaagcgcttggcagcaggttttttttatgtttaccatggtaaccccaaagagcatgacaggaagagcgattttgccgcagcttgatgaacattatctggtcattaccgcactcggtgctgaccgcccagggatcgtcaataccatcacccgccatgtcagtagctgcggttgtaatattgaagatagtcggctggctatgttcggtgaggagttcacctttattatgctgctatcaggcagttggaacgccgttaccctgctggaatcaactctgccgcaaaaaggtgcagagcttgatttgctgattgtcatgaagcgaaccaacgctcaagggcagaaagctatgccaaccactgtctgggtaaaagttgaagtgaatgactccccccacattattgaacggtttaccaacctgttccattgccacaatatgaatatcgcggagttagtctccaaaactcagccggcagacggcgagacaccgccattgctacatatacagatgagtgcacacagtcctgccagccaaaacagttcaataatcgaacatgatttttatcaactctgtacagaactcaacgcgcagggcagtattagcgtggtgagctatccacagcatgatgaccgaatggagagttagtgatgagcccattgaaagccggtgatatagcgccgaaatttagtttacccgatcaagatggcgagcaaattagtttggccgacttccagggacagcgtgtattggtttatttttatcctaaggccatgacacctggttgtaccgttcaggcttgtggtctgcgcgataatatggatgaactgaaaagtgcgggggtagaagtgctgggtatcagcaccgataaacccgaaaagctgtctcgtttcgctgaaaaagaactcttaaactttacgcttctgtctgatgaacatcatgaagttgcggaacaatttggcgtctggggcgaaaagagctttatgggtaaaacctacgatggcatccaccgtatcagcttcttaattgatgctgacggtaaggtggaacatgtgtttgataatttcaagactaataatcatcacgatatcgtgatggactacttacgccaaaatgcctaaggttttctggctatttattggtcaataaaattaacggaaaagagcgctctggcgctcttgaggttattgacaaagtgccggtggcggaaattaaaaattaattattttatccgcgttttcttctgagatatgtagcagcaccatacagcggtcaaaatgaaattttattactgttcatcatatcgatgacagcattatattatttatcaatcagctgatatgaaaaatctgactctgtaaaaatcacctcaaactgactttacttagagtcacggtatgtgtgtacttatcgattgatatatagaaataaggaataacttcatcttttttaatccacttttcagatagcccatcatgatctgataccctgtatcctaaggtagtgagatgatttttaacgtcagataaacaaacatcatccctatagacaatactactttctcttggctgactcccgtcctgagctgtaaatataaaataataagattcagctgcccttggggcagacctaatatctttgtctgtatacaaataatatgcccagatatttgaccttgtatacccgtctctcccctctgccaccttttgcatactgcaatcgataagaaaaaaaataataataatgaccagacaaataaaaatgagtcttttcaaaatcttcattatctaattactcaattgagtgatgattccagctttcttactggtgcgaataacagtgtcatcatttggatgaaatttatagggtgtaacctgcatcataaatcggggaagttgtcctttatagggtttgggacagatgaatttctccgcaggatcaggaaataaaagaggtaaaaaaccagtattcttataacgcccaatagatccatagtgatcccatcggcggagcgctgacgccttactaacaatctttagctccccccaatatgttcgaggaaaattagccctgtagaagccaaataaatcagagataagatcttcaccactgaacccactgtcagtataccaacagaaaaaagacattgattgccagttttcaaatgcaacagcagtgctcatcatcatagccaaagctataccccgtctttcagtgagtgttctgcctttctttacctgccagacgttaaaacgtccggtagcaaaccggcttaaccccatcgtttgttcataacgcacttggtaataggctttaccacttgattcaccaatggaaaaccgggtcataagcgcacgaatatcatcaccacgtgcatgccccatatcaatccagcccaaaatttctgaataaataagtccttttcggataccgttttctgaaccaaatctggatgtatctaaaatatcttcacgtttactcatccctgatatccctttttgcttaaaaatatgccctatgatagtgatcggtagttatgtgttgacaggtatcatacagtaattccgacttaacccaaatttacggcccgttcaatacaagtctacgttttagcgacttatttccctctgcgttctttgagtattaaagccatctgcttctcaaaaattaaacaccaccagatgccatgaattatccctgaagagcaaggtaatctcttcggtaccggcgctcacaatcagtcgcttaaatactgacataccggtcaactcagtatttattcgtcggttcccgccatctggctccaaatattgtggattaatgacggtttgcggtgtaccactaacgttggatgttcattggccagtaaaggtgggcgacttcatcgcggataacctcgaaatagatggcagcatcgaccttgtgaaccagatgatgttacggcgacagctcttcaagggtgaccatttcgagttgatattgttgcagagttgatattgttgcagagcagattttttttagcctgtttctatgagttcaaagtcccgaccaagaagccaggactttgttatcaacgtatttattaatccgcgtcaggaatgaattcttctggccaggcatggataaccgctttgaccagcgttgccagcggaatggcaaaaaatacgccccagaaaccccacataccgccaaaaatgatcactgataggataataaccaacgggtgcagattaacagcttcagagaacagcacggggaccaacaagttgccatctaacccttgcaccactaaataggcgacaaaaagcgtccagaaatctgccccgataccccattggaacaacgcaaccaacaccacagggatggtgacaatcacggcaccaatataaggaatcaacacagagaaccccaccagcaccgccaatagcagagcgtaattcatccccatgatgaaaaacaccagataagtggcaatacccacaatcaccatttccagcactttgccacgaatatagttagtaatctgttggttcatctccacccatacctgcccggccaaaccgcggttacgcggcaaaacacggcgcaccgcattaagcatctgttctttatctttgagtaagaagaacagcatcaatggaaccaaaatcagataaatagccaatgtcagcaagccaatcaaagaggccagagaaaatttaaccacggagtcgccgagacctgacattttactgcgtagattttccgccatcatatcgacaataccggcatcgaccagtgccgggtaacgggccggtaatgtatgggcaaaatcattgaatttattgatcatctttggcatatctgacgccagattaatcccttgctgccaagccgttggtgccacgacaaataccgctaacagcatgatactgacaaatagcacaaatacgatactggccgcccaggatcgtgaacaaccaatacgctgcaagcgggcagttggccactctaataaataagccaaaacaagagcggccagcaaaggcgctaaaataccgctgaagaagtagagaatgcagaaacccgccagtaagataaccagtaacgtaatgacctgcgggtcagtaaaacgacggcgataccattgtaacaacagctctagcatccgaaatggctccttaaatacgatgagaaatccgcaaattggcggatccctttaccctctggcaaacagggctgaacccgaaggtgaggtgttaccgtcaactcccttaatcgccatgcctttataattatttctttataactgcaggctggctaagatagcggtgagtctcaacaacggatgatgagcttaacctttgacgtatttgaacatatttttgtgatctaactcgctttcgtgatgattgtactggagagcagtgcaaggaagaagaactcttacacattacggagtctaattgtcattacactagcaggggcagtctcgtttatgacaagtcggttaagtaagacagtgatcgccacactactcagtagcttgctgctcaccgggccaatatctgctggagcggaaacccaaggcctattacccgctcaagacctattacccgatataggtacctcggcaggcgccacgctcagtattgatcaggaaatggcgatgggggacttttatgtccgccaaatgcgcgccagcgcaccattgatttatgaccccttattgacacaatacatcaatacattgggtaaccggctggttgctaacgctaactcagtacgcaccccattccatttctatctggtgaataacgatcagattaatgccttcgccttttttggcggtaacgtcgtgcttcactcagccctattccgttataccgataacgaaagcgagttggcctccgtattagctcatgaaatctctcacgttactcagcgccatttagccagggccatggaagaacaacagcggctcgcaccactcacttgggtgggggtgttaggatcaattctgctaacaatggccagcccacaagcaggcatggcaggattaagtgggacattggctggcgctcagcaaggtattatcagttttactcaaggcaatgagcaagaagctgaccgaattggtattcaggtattacaacgttccgggtttgatccgcaagcgatgcctaatttcctgcaaaaactggccgatcagtcacgatatgtctctaaaccccccgaaatgttattgactcaccccttaccagacagccgtttatctgatgcccgtaaccgcgcaaatcagatgaaaccgcaccctactgcctcatcgcaagattatctctttgccaaaatgcgtattttaggtatgtatggcgcggatgaaaatagcctgacccctgagctgctggataagctaagtaaaggcacggtacgtgagcaactggcggcaaaatacggtcaggcagtccagctttatcaggccaaaaaatatgatgaagcccgtaacctgctacaacccctactggcgcagcaacccagcaatatttggttcctcgatctcatgacggatatcgatctggggcagaataaatcagccgctgccatcgcacgtttacaaaatgcgatggtaaaacagaatgatgaaccggtactgcaactgaatctggctaacgcctatgttcagggggggcaaccggcagcagccatcaaactgctacatcgttatacttttgcctatccgaatgatccgaatggctgggatctattggcacaagcgactgccacgcagggtttacgcgatcaagaactggcggcgcgggcagagagtctggcgttgagcggcaagctgacccaggccattggcttgctcagcgatgccagtgcgcgggtgaagttgggcagcctggaacaagcccgttatgatgcccgaattgaccagttgcggcggttaaacgagcgttttcgtaaatatcagaagtcctgattatttggggctatttgctggcaagccgtttgtttattggcagatagcatctggcctgttgataaacagtaggctagctaagagaaaaacagcaaggaaagttatcatgaaagatgtcactatttatcacaatccacgctgctccaagagccgggaaacactcgcattagtcgagcagcaaggcattacgcctcaggtcgtgctgtatttagagaccccgccctcagtggataaattaaaggaattactgcaacaattgggcttcagtgacgcacgccagctaatgcgtaccaaagaagatctctacaaaacactgaacttggatgaccgtgggctgacgcaagatcagttattgcaagccatggcggataatccaaagcttatcgaacgccctatcgtggttactcaggggaaagcccgtattggccgcccaccagagcaagtgcttgagatattgaaataacgtgatgttgccgtaaccgataacccaatgtcattggcatgagtcagcaaacgagtggcaaatctgccaggagcaaatttaaatgcgactggcagcggcctctcagaggcaagtcccatggatgggccgagtaacgagcgtggctaacgcacgcacagcttgaagtatgacgagtatcaacagggcagtagccgccatgacgaagggcatagttaaagactaagaatttctttaacaaatgggatagtaagcttacgttgtgccgtaattgaggcccgatccagttgatccaacgtcataaacaaagtgcgcatttctcggtctaaacgcttgagtaaaaagcggccaacatcttctggcaattcaaaaccacgtaatttggcacgtaactgcaaagcctgcaatttttcatcatctgacaacggctgtaatttataaatctgcccccaatccaggcgcgaggccagatccggtaaaccaaggttgagttgacgcggcgggcgatcgcccgtgatcaataaacgagtacggccagtttccacaatgcggttatagagattaaacatcgccatttcccactgttcatcacctgcaatacactcaatattatcaatgcagaccagcgccagttgctccatcccctctaatacttcaggtatgaagtaagcacgtttatccagcggaacataccccaccgcctcaccttgctgcgatagctcagcacaagcggcatgtagcaaatgactacgtccaccgccttctcgcgaccagaaatagatataactgccatgaggctgatgaacggcggattggatcgctgctaacagggatgggttctcccccggataaaaactggcaaaagtttcatcatcgggaagatagagtggcagtgaaagctgtgccggcgtattcagaagcacctcaaccaacaaaacgggcgggaaaacgtgacgagtttaccacaaaaatttataacaacataacaacctgaatttggtgaaaaatgggctgaactggcaaccgcagttcagccctatctggtttttatacggcgtgggtattatttatgcaacgagcctattattgatacaacagagctcatacccatgcagatccgtatcaataaccgatcaatatctgcagcgttcaatatcagccccgaccagtatcaacttcaatcaatgcgtgggcttttcgtcctgcacatcaataatttcttcttccgtgcgaatcaagctgatcactttgaacaacaggctcagaccgatcccaaccacggtcgctaacgccatgcctttcaattcggttgcgccgatgttcactttcgccccgctcactccgataatcagaataaccgaggttaaaatcaggttttgtgctttgttatagtcaacttttgactcgatcaggacacgaatacccgacgcaccaatgacaccgtacaacagcagagaaacaccgcccatgaccggtaccggtacggcttggatcgccgccgccagtttacccacacaggacagcataatcgccagaatagcggcaccgccaatcacccaagtactgtaaaccttggtgatcgccataacaccgatattctcaccgtaagtggtattgggtgtggaaccgaagaaacccgaaatcaccgtagaaatgccgttggcaaacatggagcggtgcaggcccggatcgcggatcagatcttttttcacgatattggccgttaccactaaatgcccaacatgttcggcaatcaccactaacgccgcaggcagaatagttaaaatggcaaaccactcaaaacgtggagtatagaaagtgggcaacgcgaaccaatgagcatcacgaattggtgttagatcaaccacgcccataacgaatgataaggtatagcccaccaacaccccaatcaaaatagggataatcgcgaagaagccgcggaacagcaccgaacccagaatggttacccctaaggtcaccagtgaaatggtgatggtcgttgaatctgccgttacgccctcagctggcagcagccccgccatacccgcagcaaccccggccaactccaagccgataaccgcgacaatcgcccccatagctgccggagggaagatgacatccagccacccggtccccgctttttttacaatcagcgccaccagacagaacagcaggccacacatgataaaaccgcctaacgcgacttcataccccagcggcaacaacagcaataccggtgagataaaagcaaaactggaccccaaatacgccggaattttgcccttacagataaataaatagagcaacgtaccaataccattgaacaacagcacggtcgccgggttaattttaaacagaataggaactaaaactgtggcaccaaacatagcgaataaatgttgaaaactcaggggaattgtctgaagcagcggtggtcgttcgctaacaccaatggtgcgacggctcattatttcgatcctcttaatcagggttatacagtgttgtcttgtttagtgttgtcttgtttagtgttgtcttgtttagtgttgtcttgtttagtgttgtcttgtttagcgctatataaaaaatcaaaaaaaagccgactttcacgtcggctatcatcgttatttagttccgaaaatcttatccccggcatcacccaacccagggataatataaccgtgttcgttcaggccctgatcgatggaggcggtgtacaattcaacatccggatgcgcttcttccagcgccttgataccttctggtgcagcaactaacaccaataccttaatgctctggcagcctgctttcttgagcaaatcgatagtagcaatcatagaaccaccggttgccaacattgggtcaaccactaacgccatgcgttcgttgatattggaaaccaacttctggaaatacggtaccggtttcagcgtctcttcatcgcgatacacacctaccacactgatacgcgcactgggtacattttccaacaccccttccatcatccccagacccgcacgcaggattggcaccactgtaattttcttacctttaatctgttctatttcaaccggcccattccaaccttcgatggtcactgtttcagtttccagatcagcggttgctacgtaagtcagcaaactccccacctcggaagccaattcgcgaaaacgtttcgtgctgatatcattctcacgcatcaaaccaagtttatgttttactagcgggtgcttcacctcaacgatcttcattatttttctcctggttaggcggtcgacggccaaaaaaatcgcgagattataccgcctttctttttgaacgccataatgaatagcctgattcagatcaatagagattcaattgtacgccaagaatgctaaaaatcagggggatatcacaagccactcgcaaacgtttgcctgcgctgttagaattgtcgcgttttcttcctgcaccctaaataattcgagttgcaggaaggcggcaagcaatataatcccgatgagtctatttattttaaggtcaacgacttattttaaggtcaataacttattttaaggtcaatgacttattttaaggtcaatagccagtaagtgattcgggtgattgcgcatagccaatgcacatgtagcttgacgtattacgggtataagctcaaacagacaaccgccgtggggacctcgcagtgaccaacaaaacctctctcagttataaagacgcaggtgtagatattgatgccggcaatgaccttgttgatcgcataaaaggtgtggttaaacaaacccgtcgaccagaagtcatgggcggattaggagggttcggtgccctgtgcgcgttgccgcaaaaataccgtgaacctattctggtttcaggcacggatggcgtcggcaccaagctgcgtctggcgatggacctgaaacgtcacgatactatcggtatcgatttagtcgcgatgtgtgtcaacgatctggtggttcagggcgcagagccgctgttcttcctcgactactttgcgaccggtaaactggatgtggatactgccgccagtgtgattaccgggattgccgaaggctgtaaacaatcaggttgtgcgttggttggcggtgaaaccgcagaaatgccgggcatgtaccacggcgatgattatgacgttgctggcttctgtgtgggtgtcgtagagaaatctgaaatcatcgatggcagtaaagttacaccaggtgatgtcttggtcgccttaggtgctagcggcccacactccaatggttattcattggtgcgcaaaattctggacgtcagcaacaccaatccagaacagacctcgttggaaggcaaatctctggccgatcatttgctagaaccgaccaaaatctatgtgaaatccattctcagcctgattgaacagttagatatccacgccattgcgcatctgaccggtggtggcttctgggaaaatatcccgcgcgtactaccgcaaggcatgcaagccgttatcgacgaagccagttggcagtggccagcggtattcagttggctgcaacacgctggcaatgtcagccgccatgagatgtaccgcacctttaactgtggcgtcggtatggttgttgccttgcctgcagaactggcagataaagcggttgagttgctgacagcttctggcgaaaaagcctggaaaatcggtgtcattgccgcggcaactgagggtgctgagcaagtcatcattaatccgtaatattgctgattaatcatattgttcggcaaggcggcctcgcctctgcgaggcccaccgatggatcgggtaagtgaacatagctaaccaccctgcagcttcaagtacgaagggtatatgaaaaaaattgtcgtattaatttcaggccagggaagtaatttacaagcactcatcgatgcccaacaacaagggcgtatctctggcaagatcagcgctgtattcagcaataatcctgcagcctatggtttggaacgtgctgaatccgcagggatccctcaccatgcgctggatgccaaggcttttactgaccgcctcagttttgatctggctctggcacaggccatcgaccaatatcaacctgatttattggtcctcgcaggttatatgcgtattctcagtccagaatttgttaaacactatgctgggcgaatgttgaatattcacccctcgctgttgcccaaatatccagggctgcatacccaccgccaggcactcgaaaacggtgatcaagagcatggtacttctgtgcattttgtcactgaagagttggatggcggcccggtgatcctgcaagccaaagtgccgattttcagcgatgacagcgaagaagatgtggcggaacgggtgcaaacccaagagcacagcatttatccgttggtcgtcagttggtttaccgatggccgcctggcaatgcgtgacaacgcggcctggctggatggggtgcgtttgccgttgcagggttatgctgccgaataaccttcccttcgtacttgaagtcgcataaatactgttcaaacggcttcccggctaatgtgtctctcagtgacccccttcctgcaactcttcaatgacgttgggggtgggcattaattaaaagcaatgtcgatctaatattcgcgtttttgcctgtatataatcgcccaaaactgacgctgaggttataattctggcgacagcgattgctgccgccattgaggagtcaacatgtctaccactagcagcgtcagattacgcccactggaacgggaagatctgccgtttgttcatcagttagataataatgccagcattatgcgctattggtttgaagaaccttatgaagcctttgttgagttgtgtgatctgtatgataaacatatccatgaccaaagtgagcgccgctttattattgaaagtcagggaacaaaaattggcttggtcgaattagttgaaattaatcatattcaccgccgtgctgagtttcagatcattatcgacccaactcatcaaggtaaaggctacgccggagcagcggctaaattagcgatggagtatggcttttcggtactgaatttgtacaaactttatctgattgtggataaagaaaatgagaaagccattcatatctacagcaaattaggctttgaaatcgaaggtgagttgaagcaagagttctttatcaatggtgaataccgtactgttatccgtatgtgtattttccaaccacaatatttggctaaatataaaacaccatcgataaaaaatgcttaatacgttggggtcagatggccccaattgtttcttccccgttatctccgtcatacatcaagctacatgtgcgttggctatgcgcaatcagccgcatcactgactgagtgccagcaaagacaataacggaaaatcatcgctcatcgccaaagccgtcagttcctgtttaaactgttgactcgaacgctctgttgactcgcggcaggcatggtaagaataaataatatcaatgatgtcatcttccgtcagttgcccgtttttattggcgtaagtactgatgagtaatttcagataaaaataatcaatgaccactaaattaaatgcagcggtcaccggcagttcattccccatcgccaattggtcatgatgaatacgataaagaaggtaattacgcaataccgacgtgtgctgtaagaaaaagggccatgcctgttgagaccaggtatttctccattgcggttcaggatccgcctcggtgaaataagcccgtgccgtatgcgcataattagcgagcgtttttttaccgcggatatcaggcaattgtgtcataaaatgccccaggcaagccaataacaccttaacgagggcagtatcaggatcaaccgcctgtaactcgttcaccgcaacacccgctgccatggcactgattaatgcgtcacgcaggccatcgatttcagccattttaattttattaacgtcattgccagcctgatagctctgcaaaaattgattgattgcccaaagattttcttcaatattctcctgttgattcattgctagtgccgcacaggcacgattagccaaccgctcctccgtcacaatctcagacgccttaaaatagtcatattggttgatcgtagagaaacgtagagttaatgcatccgctgaaaataatacctgtcgagtcacttctgggcaggagagcgccatacttttaattttttgatttttataaatatgctcaacgcgaggatacgtggcacaagaggtactcaacgcattaataccggtgtgcttataaatttggcataaacgctgctcatcaagaaaagggcaattcccctgattatctgggttgatattggcccaggatgccaggctgtcttgagtaacagaaatatggcttatggcgatacgcttaatatcggagtaggggcttttgatgtatctctgataacggtttttatcgagcgtaatacttacgcctttgcagcagtgttcacgacaagccgcaccaacacagctaaacgtctccataaaatcgggttgggttatcagtagttctttcacttaacgtttccattcaatagtcgttcataacaaacgacataaaaaatggaaacttaaatcgtgagagataaatccagtaaataccttatgttgtaacgactgattttgtagcagccagcgtcaggacaattcacctcaaaataatttgcctaaaaacaatccaccgtagaacaccccaccagcctcattcagcacgcgattaaccatagcggccagtaatataatcttccgtctggcgctgatatggtgaggtgaataacgcatcggtattgttatattccaccaaacgcccttgatgaataaacgccgtgtaatctgaaacccgcgcggcctgttgcatattgtgggtcactaataccaccgtgtattgctgtttcaaggtcgtaatcagctcttcaatggttagcgtcgatatcgggtccaaagcggaagtcggttcatccaacaataatacttcgggttcaatggcaatcgctctggcgatgactaaccgttgctgttggccgctggagaggcgaaacgcattttcccgcagcctgtccttcacttcatgccataacgcggccgcccgtagcgaacgttcaaccgcctcgtcaagaacccgccggtcacggaccccctgcaagcgtaaaccgtataccacattctcataaatagatttaggaaatgggttgggccgttgaaagaccatgccaactcggcgacgtaatgcggcaacatcggtggttttatcggtaataatttcatcacccagccggatctctccgtcaaaatggcagttatccagcaggtcattcatccggttaaaacagcgtaacaacgtggatttaccacaacctgaagggccaatcaacgccgtgacccgatgtttggggacacagaatgagatgtcatgcagcacctgcttatcaccataaaataaattgagcctctcgaccgccagtgcagtttgctcatcagtcaaatgctgtacatcaagtagcggcaacgaattcggcgtcaaaagtcccatatcatgtcctgcaggttaagaatccaattacaacattaagccacggtacttctcacgcagatggtgacgaatccccatcgcggctaaattaaggccaacgacaatgatcaccagtagcagtgcggtggcaaaaaccaatgggcgggccgcttccacattcgggctttggaacgccatatcatagatctggaagctcagatgcatgaatttgcgctccaaatgtaggaaagggaaaataccatcgaccggcaataccggggcggatttaaccacccccactaacatcagcggtgcggtctcccccgcggctcgagcgacagctaaaatcagccccgtgagcatcgcaggtgccgccatcggtagcacgatgtgccacagtgtctcggccttgctggcccccaaagcctgtgacccttgccgcaaactggttggaatgcgggctagcccttcttcggtggcaacaatcaccacgggcaacgtcaataaagccagcgttaacgccgcccacagcacacccggtgtgccaaatgttggattaggcaatgactcggcataaaagagcttatctagcgaaccaccaatcagataaacaaagaaccccagaccaaataccccatacacaatggaggggaccccagccagattcaccacagagatacggatcaggcgagtcagccaatttttcccggcgtattcatgcaaataaaccgccgcgatcacccctaatggcatcaccacgatagacattaaaatcaccatcagcaccgtaccgaaaatagcgggaaaaacaccgccttcggaactcgcattgtacggattgtcggtcaaaaactttttggtttgtgccgcccagtgccgcaacttctgcccgaaactcatgtcgttgggataccaggcccggttaatttcactcagtggcagcgggtgtatttgcccattcatatcttgccacaagagtgtatagcggtgtttttccgtttgtaagctccgcagtttatcgataagagtctggtgacgacgttgtaattcccccagctctgcgtcaatacgatcctgcgatttgctgtctaaatctccggcgatttgcagccgtttcttttgtaaccgtaatgcttcaaattgttgattgagcatactcatttggcggaactgaatatcattagcttgcctgaccagcgcctgcacaatggggaggcgtttttgcagctcttgtcttaggttatcgccaactaatggctgcccgttatccaacataccggcaagcaaaccatacgccataccattgttatggcggtccagagccaatagccccttcggcaggctgcgctgttgaatatcactctccagcaaggtatagaaatcctgcccctgaacctcacggttacctgacttgatcagcaagcgagtgactgaatcacccgtatttggcggtagagtcatcccggcctgttctaattgctgccgcggtagagattgttgccgataaatttcccccaccagtcttaccgggccggcagcggtttgtttcaactcaaattggtagaccgggctgggccagaaataacgcattccctgccctgccaacaataagatgacgccaatcagcgccaacaagctaatactgactgacgccgcagttagccagatccacggcgagccagatttaacccatttgtttataaggcccgtgtttataagacccgtgtttataagatggatgtttgtagatcctgttttcatcacgctgtccgctccatttgatagcgttcacgcagccgcaggcgaaccgcttctgccagcgtattcaccaaaaacgtaaagcagaataagaccaatgccgtcaggaatagcacccggtagtgcccactgccgaccaccgcttccggcatttcaatggctatattggccgccatcgcccgtaacccttggaaaatgctgccatcaataatgggcgagttaccggttgccatcagcacaatcatggtctcacccaccgcacggccaaaacctatcatcaccgcagagaaaataccggcgtaggctgaaggcagcaccacgtggagcaatgtttgccagggggttgcccccagagccaacgagccttggcttaatgacgggggcacactgaacagcgcatcctctgccagcgaaaaaataatagggattaaggcgaaccccattgccacccccaccaccagcgcattgcgctgatcgtaatcatcccccagccactcatgcaacggttggcccaacgcccacaccgccaatgatggccccaaccacagggccagccatccggtcagtaagatcaccggcagcagtaccatcacatcccagcccgcaggtaatggccattgtgtcttggccgacaggcgagcgctgccccaaccacacaataaaatcgccagggctagcagcagcggcaataacaagatccccgccagataacgttcaatcaccggtgccagccagatccctgcaattaaaccgataaccaccgtagggaatgctcccatcatctcaatggtcggtttaacgactcgccgcaaccccgcagacataaaatacgcagtgtaaatggcccccgccaatgccaacggcaccgcgaataacatggcataaacggccgcctttaaggtaccgaagataatcggtatcaggctaaatttggcctgatagctctcttcggcagaactcgattgccatacataggctggctctgggtagttttcataccataacggctgccacaggccacgccaggtgatgtccggataacggttgtctagccgataaactgaccacccggaggcgttttccactaacaggctatcgccccacggcgaaaaatcggcatggctgataccttcgaccaacgtagagtgcagtaacggcggtgactggatgctggaaaaaagggataactcaccgtgtggcgagagcaaagcaaagacccggcgggtgttctccgcggtgagtattccctgacttgctggtgtaaaactgcggatccgcgtcaaatggaacgatgggcttggcccttttcgcacatcaaaccattgggtcaccacaccatccggtgattgcaccaacagcgatttccctccagccaataaggagagcgttaaaggcccactgagcgcttccttttcacccaccagagacaccacttcgcgtaactgccagccggaacctggtgcgtcactcgcaagtttttcactctctaatggcctattgaccaattggtaaatatgcacttgattgcccgaaagcacatagagtaagcggccatcaggcgcgagcaacagttgatcgacagtggcgggcaccgcgccaagagtggttatctgctgcccctgcggggtgaattgccccaccaacaagcggctatcatcggtaatggcagcaacggaaaattgctgtggttgcggctctgccagcgccaaatgcagcaagcgcttgccttgtatatcgagcgcacgcggttgatcgcccaatggaaattgccagccaggcggggtggcagaaaaatcgggttgtagcagagtaaagcggccattactcagaccggcaccatataaaggctgcccgccgatggcacggctccatgagacgggcggcgcggataacgcctgttcattgatgacactgccagcaggtgcactcccttgcccaccaaggcgaacaaacacacctttaccttggttatcaatgcgataagctattttcccttgaatatccattcccagagcgagtgccggcgcattgcgtttcaccacgaactgattatccaaacggatagaaacaggtttaaataatggcaatacggcatacaataagtagacaaatatcagcatcagtgtcagtaataccagcaaaccaccactggtgactgtcatgcgcacccaacgatcaataaaagcccggcgcttatctctccctgatggtgacgctatgcttgtttgccgcataatgtttagttgcctcatgccttacaccatattccgtcaatggttactgcccgtgatgaatctttcaggcatttacatgctaccgtttcaagctatctgttcaaataagttgttcaaataagctgttcaaatgaccgagcatcttatgtcagttttgtggcgtttgcatgacaatgttaactaatgatatctgttggacttttttgtcaatttttcgcaataatgtttacggacactaaatactcccacaataatcttaatggagttgcaatgggtcaggaaaagctctataccgaaaaagaactcagttggttatcttttaatgaacgggtattgcaggaagcggcggataagagcaacccgcttattgagcggatgcgatttcttggcatttactccaataatctggatgagttttataaagttcgttttgccgatctgaaacggcgcattcttattaacgaagagcaaggctctgctgtgacgtcccgccatttgctgaaaaaaattcagagcaaagtggtgaaagccgatcaagagtttgatgggctgtataatgacctgttactggaaatggcccgtaatcaaatctttttggttaatgagcggcaaatttccgagaatcagcaaacgtggctgaagcaatactttaaacagcatctgcgtcaacacattacaccgatcctgattaaccatgacaccaatctggttcagtttttaaaagatgattatacctatctggcggtagaaattattcgtgggcaggatattgcctatgccctgctggaaattccatcagataaaataccgcgctttgttaatttaccgcctgaagcgcctcgccgtcgcaagccaatgatattacttgataatatattgcgcttctgtctggatgaaatatttaaaggcttctttgattatgatgcgctgaatgcatattcaatgaaaatgacgcgggatgccgaatatgatttggtgaccgagatggaatcaagcctcttggaattgatgtcatctagtttgaaacagcgtctgacagccgaacccgtgcgttttgtttaccagcgggatatgcccgatgaaatggtagaactcctgcgcaataaattgggtatatctaacgatgattccgtgatcgccggtggccgttaccataatttcaaagactttatcaacttccccaatgtaggcaaaagtaatctggttaaccggccaatgccacgcctgcgccatgtctggtttgataaattccgcaacggttttgatgccatccgcgaacaggatgtgctgctgtactacccgtatcatacctttgagcatgtgctggagttattacggcaagcctcattcgatccaagcgttctggcgattaaaatcaatatttatcgggtcgccaaagattcacgcattatcgactcgatgatccatgccgctcataacggcaaaaaggtaacggtggtcgtggagttgcaggctcgctttgatgaagaggccaatattcattgggctaaaagtctgacggcggctggggtacacgttattttctctgcgccagggctgaaaattcatgccaaactgttcctgatttctcgccttgaaaatgacgaaatcgtgcgttatgcccatattggcaccggtaactttaacgagaagaccgccagaatttataccgactattcgttgctgacggcagatgccaggattaccaacgaagtgcgccgggtatttaactttattgaaaatccctatcgcccggttacgttcgataatctgatggtttcgccacagaattcgcgcttaatattatatcagttgattgatcaggaaattatccacgcacaggccggtgaaagcgcaggaattaccctaaaaataaataatttagtggataaaggcctggtagataggttatatagcgcctccagtgctggcgtcaaaatacgtctattggtacgcggtatgtgttcattaatcccgaatatgccgggtatcagcgataatattcaggtcaccagtattgttgatcgctttttagagcatgaccgtgtgtacgtctttgagaataaaggcgataagctggtttatctctcctctgcggactggatgacccgtaatattgactaccgaattgaagtggctgtttcgctgttggatccaaaattgaagcagcgggtgctggatattttagagatattattcaacgacaccgtcaaagcccgttatattgataaagagctgagtaatcgttatgtaccgcgtggaaaccggcgcaaagtacgtgcacagattgctatctatgattatttaaaagcactggaacaaccggagcagtagacctaacactatgccgctaaccaataattcgactaccaaaccgcaggaaatcgccgccatcgatcttggctctaacagtttccatatggtcattgcccgtgtcgtcaacggcgctttgcaagttttagggcgcctgaaacaacgcgtgcatctggccgatggcctggatagcaataatatgctcagtgaggaggctatcgagcgcggcctggcctgtctggccctgtttgctgaacgtttgcaggggttctccccagataacgtgtgtatcgtcgggactcacaccctgcggcaagccgccaatgcagagacattcctcaaacgtgccgccgaggttatcccttatcccattgaaattatctcgggccaggaagaggcgcgcctgatttttatgggcgttgagcacacccaaccagagaagggccgcaagctggtgatcgacatcggtggcggatcgacagaaatggtgattggcgaggactttgagccattgctggtagagagccgccgtatgggctgcgtcagttttgctcaacagtttttccctggtggtgaaatcagcaagaataatttcagacgtgcgcgtctggccgcggcacaaaagttggaaaatctggcatggcaataccggatccaaggctggcaatatgcgctgggtgcgtctggtaccattaaagccacctatgaagtcttggtcgaaatgggcgaaaaagacggtttgatcacgcctgaacggctggagatgctggttgaaaatgtcctgcaattcaagcaattctcagccctgagtctgccggggctttcggaggatcgccaatccgtatttgttccagggctggctattctctgtggcgtattcgacgcattggccatcaaaacattacgtttatctgacggtgcgctacgtgaaggtgtgctgtatgaaatggaaggccgcttccgccatcaggatatccgtcaacgtaccgccaagagtttggcagatcactacaatattgatcgtgaacaagcccgtcgggtgctggaaaccacggaacaactgtatacccagtggttggcacaaaataccaagctggtacagccccaactggaagcattattgaaatgggcggcgatgctgcatgaagttggcctgagcattaatcacagcggcatgcatcgtcattcggcctatattttacaaaatacgaatttaccgggcttcaatcaggagcaacaaaccctgttggcgacgttggtccgaatgcaccgtaaagccatcaaattggatgaattgccacgcctgaatttattcaagaagaaatactatttgccgttaattcaattattgcgtctgagcacattgctgaataatcaacgccaatccaccaccacaccagaaagcctgcggttgataaccgacgacagtcactggacattgcgttttccacatggctatttgacgcaaaacagtctggtgcaactggatttcgaacgcgaacaggcctactgggatgatgttgtgggttggaagctggttattgaagaagaagagccggatgaggctgcaaaagtggcccctgaagagtgatctgacgctgataaaatcgtgcaccgggtggttgtcatcacccggtgcgtcaattgacagcatgagcggttaaatcattcgtcgttaaaacgatctgtatttataacgatcagtagttaaaacgatcagaacagtagttaaaacgatcaatcgttaaacgatcattgctaagcgataaaacaaaggctatgcgaagaagaccttcaactcaattgacgaaaattatcttgctggtgagtttcctcattctgtttggccgcctgttgtatgcggcaatcgcgtcgatctcccatcaccaagagcgtcagtctcaacaaattgaactgtcagtcgagggcgaacctcctggcccgcatcaaacagaccttagcccgtagatttgatgccaatccctacgcccttagaatgtttagatccaaggacacattatgcccgtgcctattattcccgtgtcactttctgccgctgcccaaaaaaatgccaaaatcaacactaaaaaactggccgaaatacgcgaaagaatcctctccctcctattaaataatcgagcgctggttgacggtattttgggccgtcaggaggagcgggaaaatctcagtgatgaacaactgcaggatcaaaccgcagaaataaaaaccttgctcgatgacctgcatgcagccgatctcgccgacttactggaagcattacccaacgacgaacgtttggcactctggcggttggttaaaaatgagaagcgcggccaaacactggttgaagtctctgagaccgtgtgggataccctgatcaaagagatgagcgataaagacctgttaaaagccatgcgcaccttgcatgtggatgaacaggcttatctggccgagtatttaccgcgtaacctgatgggccgcttactgacgtcattggatccagatcaacgggccagagttcgtgaagtgattcagtatggccgcgacagtgtcggccaaatgatggattttgagctggtcaccgtccgcaaagatgtcacgctagcaaccgtacagcgctatttgcgctatcggaaacgtatccctgatgccacagataaactgtttgtcattgatcgcaaaaatacgttactcggcgaattacccctgacatcaatcctgctcaatgcaccgaacaccttggtgtctgaggtaatggatcagaatccgacgacgttccaaccagagcagaaagccgaagatgcggcaggtgcctttgaacgttatgacttaatcagcgccgccgttattgatgctaaaggtaaactgatgggccgcctgaccatcgaagagattgttgacgtggttaatgaagagagcgataccacgctgcggcgcatgggggggttaagcccggaagaggatgtgttctccccggtaggccgtgcagtgcggacccgttggtcatggctggcaatcaatctttgtactgcctttatcgcctccagagttattggtttatttgaagacacgatttcacagttagtggcgctggcggcattaatgcccattgtcgcaggtatcggcggtaataccggcaatcagaccattaccatgattgttcgcgcattggctttacaccacattcaacagggcagtgtctccttcctgatgttaagagaattaggggtggcactgattaatggcctggtctggggagggattatgggccttgtcacctacctgctgtatggcgacccggcaatgggtgcggtgatgacgttagccatgatgctcaatctattgatggccgcggtaatgggcgtaaccatccccatgaccatggcccgtttaggtcgtgatccggcgattggttccagcgtcatgatcaccgccatcacggataccggtggattcttcatctttttaggcctcgccaccctatttttagtctagtgacattctccgcctgcaccgtgattggcctccccatcatcggcggcaggtcgcgccctgatttggagagtgatccacttgctcccatgttcactctagggtaaagtcgcccccctttatttggcctggggagcaattgatgttcattggatttgactacggcacagcaaactgctcagttgccgtgatgcgggatgatgctcccacgttgttggcgttagaaaataacgacgtctatttaccgtcgatgttgtgtgcacccacacgcgaagccgtgagtgagtgtctgcatcgtcactggcaagtgccaacgggcagcgacgaaaaccaacaactcttgcgtcgggccatcgcgttcaatcgcgaagaagatattccggtaaccgccgatagcgtgctgttcggcctctccgcccttgctcaatacatcgaagaccccgaagaggtttactttgtaaagtcgccaaaatcctttttaggcgctaatggcctgaaacctcagcaattggctctgtttgaagatttagtctgcgccatgatgtttcacatcaagcgtcaggctgaatccgttttagccgcagaaatccgtcaaacagtcattggccgcccggtaaactttcagggttccggcggcgaagacgctaaccggcaggcggaagggattttattacgtgccgcacaacgtgccggtttccgtgatatcgccttccagtttgaacccgtggctgcggggctggatttcgaagcgacattaacggaagaaaaaaccgtcctggtcgtggatatcggcggggggaccaccgactgttcggtcttattgatggggccgaagtggcaaggtttggctgatcgccaacagagcctgctggggcatagcggctgccgcgttgggggtaacgatctcgacatcatgctggccttcaaacaattgatgccactgtttgggatgggcggtgaaaccgagaaagggattgccatgccgtccctgccatattggaatgcggttgccaccaatgatgtcccggcgcaaagcgacttctacagcacggttaatggccgtttcctgcgtgatctcatccgtgatgccgctaacccacagcacgttgcacggctgctgaaagtgtatcaacagcgcctgagctaccgcttggttcgcgccgcagaagagagcaaaattgccctgtctgaccaagagcaggtcgctacaacattggattttgttgaagccgaattgggccaaatcatcagccagcaacaactggccgaagcgattagtccaccgctacaacgcattcaggagcaagtcagcctggcgctgaccaccagcaatgtcaaaccggatgttatttacctgacgggtgggagcgcccgctctccgttactgcgtgccgcgctacagcaacaattgccggggatcccgttggtgggggggaacgatttcggctcggtgaccgccggactggcccgctgggctcaaaccctgtaccgataacccctattatgttcacctctcagtgagttatctcgcactgagagtttttgttggcgtatcacttgcaagactgcatgtgcggcgcggcaacgagagtggtcaacccatagagcgcctgtacaacttgcgccgcctgagtgaccgatacgatgggaacatcggtggtcaataacgcctgtgccgtggtcatctcagacatgctgccctccattcacctccctatccggcgtttatatttaattccatgcccctcggcttattccccggcagattatggggacactggatgatggcgtaaacgctcactacgccgccggagcagttccatcacaatcagtaacaacagcgaagcgccaaccattaatgaagcggccgccgcaatagtcggatcgagattttcacggataccggcaaacattttgatcggtaatgtgcgctgacgcgggctggcaagaaacagtgtcacgaccacttcatcaaacgaaaccgcaaaagcaaacaaggcacctgaaaatacaccgggggcgatcagcggtaaggtgaccttacgaaagacccgccactgtgatgcccccaagctggcggccgcccgcgacagattctgatcataacttttcaagacagcggtcacggtgatcacgacaaatgggaccccaagcaaggcgtgggccaagactaatcccaggtagctgttgagcagtgataagcgggcaaagaagaaaaacatgccaacagcaatgatcaccaccggggccaccattggcgaaatcaacatcgccatcaccaacgccttgccccgaaactccccgcgcaccaagccaatggcggccaaaacccccagccccgtcgccagcaaggtcgccaacggggcaatcagcaggctgttgcccaaggcccccagccactcatccgagttgaaaaaggtctgataccaacgcagtgaaaaacccgccattgggtaactgagaaaagaacccgcattaaacgacagcggcacaatgaccaataccggtacgatcaggaataataaaatggcggcgctgtaaaaattaaatacccatttccaccccctaagcagccacgcccctttttgtttcagtgccttttgtggtttcggcatcgtctcctccggcacaatgtgttgataagctcatgaacggataaacacatcaatagatgaactaatgaatcgcggtttcagcctgggtacgggttactcggatataaaccacgtacagcaacaggacgataatcaataactggctccccaacgccgcggccattccccagttcatggtggtattggtaaagaaagcgacaaagtagctcaccatctgatcacccggaccgccgagtaatgcgggtgtgatgtagtagccaatcgccatcataaagaccagtaacgcgcccgccgtaacgccgttgtaggtttgcggtacataaacacgccagaaagcagcaaacggatgcgcacctaatgaaatggcggctcggacataattgggcgaaatacctttcatcacggcatacagcggcaacacgataaagggcagcaggatatgggtcattgagatgtagaccccggcgcggttaaacaccagcgccaatggttgttcgataagcccactccccagcagcgactggttgattaacccactggactgcaacagcacaatccaactggcggtacgcacaatcaatgaggtccagaacggtaacaacaccagcatcaacaacaggttggcgcggccagtgggctgttttgccaaccaatatgccagcgggtatcccaaggtaacgcataacagagtgacgacagccgccatccataacgttcgcagcaagacgttaacgtacaacgcttgatcagccggtaatgccttaatttgcccactttctacgtctactttacggtcaaatgcagatagcaggtaatagcgggtcaagggctgagtcgcccgttgcagcgattgccaagtgcttaattccccccacaacggtaacgcactgattagcgcttcacgtaccggcccttcagccggtactttccgtagtgtcgacatgatcaggctacgataacggttatcttcataactcatccgtttggcgatcgagagcattaatccattgctacgcgcgttacgcagatcagtgatcaatgcctcgaacattgcctcgtccggtagcgcatcgccaggccaattcgccagtacagccactgttaccggcatggccaccctcaattcggggttatcgatacttttccccaagatagtcgcaatggggaaaataaagctaacgacgataaacagcagcagcggtgtaatcagtaagagagatcggcgtgtgtaggccgccttcactttgcgcagttgttgacgcagtatcgggccagattgctgccgctcatccgctacaggtttggtgaccatctcggtttggctcattgcgttccctccggaaaccgtgggtctacgccagcagctatcgccgttatttagctgcccaagagttgaagcgttgctcaagatcttcgctatgctcgacccagaattgattgttcatgggaaaagcctcagccaggttggctggcgcagtgggtaaattagcggcgatttcgggatcaatcatcaaggtggcgttgatattggtcgggccataagcgatattttctgcaaagactttctgattttccgctaagttggcaaaggcgataaattgttctgccaatactttttttttggagcctttgacgatagtccaactgtccatatcgtagatactgtcagtccaaaccattctaaaatcatggccttcttttagcgcggaccccacacggccattatagactgaccccatcacaacatcaccggacaccagccattgcagcggttgcgccccagattcccaccactggatattcggtttaagttgatccagttttttgaaaacacgttcaacaccttccggcgtcgccagcacacgatacacatcctcacgtttcacgccatccgccagcaacgcaatttccatggtaaatttggcagttttgcgcagggaacgtttgccgggaaaagtggtgacattccagaagtcagcccaactggtcaccggggttttaaatttgctggcgtcgtagattaatagcattgaccacaaaaaaagacccgaaccacattggctaaccgtgcctttaatgaactgacgttcatcgcctaacttgctccaatccagggtttcaaatagcccttcattgcatccccgtagcagttctgggccttcaacttcgacgatatcccaccctatttgacccgtttccaccatcgcacggatacgggccatttcaccgttatactccccggcttcaattgttcctttcccggcggccatgaaaggtttatagaacgccttaacctgtgcgtctttgtttaaaccaccgaatgacaccaccgtcagggtttcagcgtgcgtttgaaatacccatccggcgagcagcgtagtcagtgttattattttaaacatgctgtggctcctggtaacgggttaacgtttcgagatcagtgagataaaacctttagctcgccagtaggcgggtaagaatattcatcgcctgtttaaattgcttgtcgggaatggtcaatgggtagaggaagcggatcacgttgctgtggacaccgcaactcaggagtaacagcccctcttccagtgcctgacgttgataggcgcgcgtcagttctggtgacggtttaccgctgacgggatcgttaaattccaccgccaccatggatccacgcgcacgaatgcccacaatggccgcattgctcatttgggctttttccagtacgtcgaccaacttcgcgcctaaaatcagggcgcgctcgcataacttctcttccgcaataatatcgagcaccaccagtgacgcagccaccgccagtgggttaccggcataagtaccgcccaaactccccggcaacggggcatccataatgtcggcccgccccgtgaccgcggaaattggcataccgcccccaaggcttttcgccatggtgatcacatcaactttggtgtcgggataatattccatggcaaataacttgcctgtacgggcaaaccccgtttgtacttcatcggcaatcagcaaaataccgtgctcatcacacagggtgcgcaaagcactgacaaattccggcggggcgatattaaaaccaccctcgccctgaatcggctcaaatagaatggccgccacttgtgtcggactgatatcacaacgaaacaggcgctcaacactgctgatggcctcttcaacactcacgccatacaactcattgggatagagggcgtgaaaaatggaggcagggaacgggccaaaaccgactttgtacggcaccgctctaccggtcagcgccatcgccaataaggttcggccatgaaatgccccggagaaagcaatcacaccagggcggccagtcgccgcacgcgctattttcacggcattttctatcgcttcgaccccagtggtgaaaaaagcggttttactgttgcccgctgccgtcatatttgaatcagaaataggggctagcgaattaattttctctgccaatgtgacataactggcgtaaggcaccacctgataggcagtatgggtaaactggtccagttgttggcgcacagcggccatcactttcgggtggcggtgtccgatattgagtgtcgcaatacccgccgtaaaatcgatatattcccgcccctgttcatcccacagcgtggcattttcagcccgtaccgcatagaaatcacataacacaccaatcccacgtggggtcgcctcttttctgcgttgttccaattcacggtgactcatgattcgctcctgccggtatgccatgggtcaatccccccacgggggcgtatgtggatgactgtctcggttcgtaatgactaattcgtcgattaatttgtatattaattaacctagtctcggttttttatccctaagtcgccctacaatccagtgccaattttgattattttaaggtgccaatttgcgatcactgctttctgacctgctgttacagcgcctgacaccggctaccctctctacggttccagtggctaaaaataagcggctctaccgtgcgctgcgtttatctattctggacggcagcatccgtgccggtagccgcttaccggcatcacgtgatctggcacaagaactggagatttcgcgcaatacggtgctggccgcctatgaccaattacaggcagaaggctatattcagacacgtaccggcggcggtacctttgtgaccactgatttgccagaagacgggctgaacaaaatggataccctgccccagcatagtgggccagaacctgatgtggccctgtctacacgcgctacccacctgctgaaccactgcggcgtggcgtcctatcaatggggcaccttcatgcccggcgtgccagatgtcaggttatttccccatgaggtgtggcgtaaattacaaacgcgtctcagccgccatttgaatccagaaaatctgacttattctgttcatggcggttgtccgcaattgcagcaagcgttggccgactatctgcgaattgcccgttccgtttcctgtactccggatcagattttgatcactgcgggcacgcatcaggcactggatttgttggcaaaaatgttatgcgacccgggcgatcacgcctggattgaagaacccagctactgggggatccgcaacgtgttaaccatcaatggcatagaggtcatccccgtgtcagtggacgaaaatggtatggatccactggatttgccgtttgaatcgcgttcgccacgtcttatttgcgtgacgccatcccatcaatatccgttaggctcggtgatgagcctgacacgacgtcagcgtattttggcgttggcgcagcagcataactgctgggtggtggaagatgattacgacagcgagttccgtttttcaggcagtccgatccccgcgctgcaagggctgatccccgatgcgcccgtcatttatctcggtaccttcagtaaaaccctgtatccagggatgcgtatcagctacatggtactgccacgcccactggcgcagcagttcaaggtggcacattccgagttataccgtggaggaaatgggatgatgcaactgacgctggcagaatttatccgcgaaggccactatgcctcccatatccgtcgtatgcggttgatatatggcaagcgccgggccgcactggttggcatgatcaaacaacaacttggggaatcatttctcgcggaatacggtaacgcggggctgcacctgattctggccttgccggagtctattgatgacgtggcgttaagcgctgaactggagcaaaaaggggtactcgtccgtgcgctctctggctattacttaaaaagtcccccgcgacgagggctgttactcggttatggttgcgtaccagaggaggcgatggaagccgtattcgcaccgatagtcagctatctcagacggcggataaaccccgatgacgcgatctgaaacgggcagtttatcaatcaccgcctatcgatttcactgcattaattaaactgcgtcaccaccttgaccaagcttgcctatttctgtctaaaccctcactcatgcagagtataaaaatcatacagataaaaacaaataaaataataatatagataaaaatcaatatattaaataaatcattcacacgtgaggtaatttcctcattgagtcaaaaaatgcttgtccagatgaaaaacgaatggtaaagcttttaaaaagtcccccgccgtggaggcaacgacgagtgtgacgatccggttctggcatgagtcgtgctctgcagcaaatctattttgtttaacgaccaaaatgcttgttcaacaataacttgagagtgtgcgcaatgagaacctatgtcagcttcaaaaatatcaagaagagctacgatggcgacaagctggtcgttaaaaacctgaatctggacattcatgagggggattttttaaccctgctcggcccttctggttcaggtaaaaccaccagcctaatgatgctagccgggtttgaaacccccactcaaggcgagattacgctgcgtgataaacccctgcataacctgcccccccaccaacgggggatcggtatggttttccaaaattatgccctcttcccacatatgaccgtaactgaaaatctggcctttccactcacgatccgccgattgaataaggctgatatcaaagagaaaattgaccgtatattggatatggtgaagttgaagaatttggctgaccgctatcccgcgcagatgtctggtgggcagcagcaacgggttgcattggcacgtgccttggtatttgagcccaaactggtgctgatggatgaaccactcggggcgctggataagcagttacgtgagcatatgcaattggaaatcaaacagttacataaaatgcttgaattgaccattgtctacgtcacccatgaccaaagcgaagcgatgactctgtcaaatcgggtggtggtatttaacgatggtattattcagcaaatggatagcccaagcgtgatttatgaacagccaagcaatacttttgtggcgcaatttattggtgaaaataactgcttactggccgttaatcagggcagtgacggggaatattaccgtgccatgttggacgatggcacccgcctgcaagcattaaaagtgtgccccagctcaccgggtaaaaaaattatgttatgtattcggccggagcgcgtcagtgtgaatcatcctgcggtgggcagccagcagatcaaggcccgcattcagcaatttatttatctgggggaccatgtgcggatgatgacggaggttgcaggccaagggaatttcatggtgaaactctctgccgcgcatatcgaaccacactggcagccaggaagtgaggtgttgctgtcgtggatgcctgcgcatttaagggcactggagggggtgacacactgagagtgaagtttgaagtttgaagtttgaagttcgttgatcgttggggattaatgatcgctgggcgttaatgatcattggatattcatgatcgtttgctattcgtaccccaaatggccgtgccgtattgattgccacttctgccccctgcgcaactcgctcaccgtctcgcacaatgaatattcaggtcgttgccgagaaatagccagaaattggtatagacttatcgttatcctctcccttcatgccgtttgtaaagcaggccagacaaactctgacactactttcatatttcctccatttttatccggtaattgcccgttaaactagtagcatatccgaaaactcagagactgcgcccatgtggtgcaggtagccacgataaaaaaggacgcttcgccatcatgaaatctcaatccaaacgcacttcccgattattcgtattcgtgggggtagtggtggcgatcattattgcggtgcttagttggcgctacttcggtaccggctccgataacaatacgtcaggtgctcagcagagtgcccgtggtcaggacactagccatggtggccgtcgtaatacaccgctggcaccggtgcaggccgcaaccgcaaccgagcaggaagtgccacgttatctcactggcttagggacggtcattgccgccaatactgtcacggtaaccagccgagttgatggtgaattgatggcccttcatttcactgaagggcagcaggtcaaggctggcgacttactggcagagatcgacccccgcccttacgaagtccaactgacgcaggctcaggggcagttggccaaagatcaggccacgctggataacgcccgtcgtgatctggcccgttatcagaaattgtccaaaactggcctgatttcgcaacaggaactggatacgcaatcttcgctggtacgccagagcgagggcagtgtgaaagccgatcagggcgctatcgacagcgccaaattgcaactgacgtatagccgtattaccgcgcctatctccggtagagtgggcctgaaacaagtggatgtcggcaattacattaccagcggcacggccacaccgattgtggtgatcacccagacacatcccgttgatgtggtctttaccctgccagaaagcgatattcccgccattatgcaagcacagaaaaatgcggagaagactcacgccatcgtgcccgttgaagcgtgggatcggacgaataaacagatgctggcacagggctacctactcagtattgataaccagattgataccacgacgggcaccattaaactgaaagcccgctttaataatgaagatgatgtgctgttccctaatcagtttgttaacgcccgtatcaaggtcgatttgctgcaaaatgctgtcgtggtgcccaccgcagcggtacaaatgggcagcgaaggtaactttgtctggacgttagatgatgcaaatagagtcagcaaacatctggtcaccaccgggattcaggacagccaacaagtggttatcgacgcaggcctgaacgctgggcaacgcgtggtcacggatggtattgatcgcctgaccgagggagtacaggttgaagtggtgacaccacgcagcgccaatactgacactaatccagccagtgcagagaaagcggctgcagaagcagaaggcagcaccccgcatcaaggccgagggcgtccggccaatgcgcctgcacgtagcaccacggctgcggagaaatcctgatgcaagtgatgcctccaacacccggtggcgggccgtcacggctgtttattctgcgcccggtcgccaccacattatttatgatcgcgattttactggccgggattatcggttaccgcgccttgccggtctcggcactgccagaggtcgattacccaaccattcaggtggtgacgctctaccctggagcgagcccggatgtcgtgacatcgtcaattaccgcgccgctggaacgccagttcggccagatgtccggcctgaaacagatggcctcccaaagctcggggggcgcatcggtcattaccttgcaattccagctcaccttgccgctggatgtagcagaacaagaagtgcaggctgccattaacgcagcgaccaacctactgccttccgacctgccttatccaccgatttacaataaagtgaatcctgcggatccccccattctaacgctggctgtaaccgcgaccgccatccccatgacacaagtagaagacatggtggaaacccgcattgcgcagaaaatttcacaagtcacgggtgtcggtttagttaccctctccggtggtcagcgcccggcggtacgggtgaaattaaatgcgcctgccgtggcggcactggggctggacagcgagaccattcgcaccgccatcagtaatgccaacgtcaattccgccaaaggcagtttggatgggccaacccgttcggtgacgctatcagccaatgatcagatgaagtccgccgaagagtaccgtgacctgatcatcgcctaccaaaatggtgcgcccatccgcttacaagatgtcgccaccattgaacaaggggcggaaaataacaaactggccgcctgggccaatactcaatcagcaattgtgttgaatatccaacgtcaacctggggtcaatgtgatcgccaccgctgacagtattcgcgaaatgctgcctgagctgatcaaaagcctgcctaaatcggttgatgtcaaggtgctgaccgaccgcaccagcaccatccgcgcctcggtcaatgatgtgcaattcgagttactgctggccattgcactggtcgtgatggtgatttatctgtttctgcgtaatgccgccgcaaccattattcccagtatcgcggtgccgttatcgctggtcggtaccttcgccgccatgtattttctgggcttttcgatcaataacctgacattgatggccctcaccatcgccaccggttttgtggtggatgacgctatcgtggtgattgaaaatatctcccgttatatcgaaaagggagagaagccgctcgatgccgcgttgaagggggccggtgagatcggttttaccattatttcactgaccttctcattgattgccgtgttaattccgctgctgtttatggaggatatcgttggccggttgttccgcgaatttgccgtgacgctggcggtcgctatcctgatctcggcggtggtttccctgaccctaacaccgatgatgtgcgcgcggatgctcagttatgagtcactgcgtaaacaaaaccgcctgtcccgcgccagtgagaaattctttgactgggtgatcgcccattatgctgtcgccctgaaaaaagtcctcaatcatccgtggctgaccctaagtgtcgcgttcagcacactggtgctgacggtgatactttacttgctgatcccaaaaggctttttcccattacaagacaacgggctgattcaagggacactggaagcgccgcaatccgtttcgttcagtaatatggccgaacggcagcagcaggtggccgccattatccttaaagatccggcagtagaaagcctgacctcgtttgtcggcgttgatggcaccaatgccaccctcaataatggccgtttgcagatcaaccttaaaccgttaagtgaacgggatgatcgcattccacagattattacccgtttacaggagagtgtcagtggggtgcccggtatcaaactgtatttgcagccggtacaagatttgaccattgatacccagctcagccggacacaatatcagttcacgctgcaagcgacttcgctggaagaactcagtacctgggtgcccaaactggtcaatgaattgcagcaaaaagcgccgtttcaggatgtgaccagtgactggcaagatcaggggctggtggcgtttgttaatgtggatcgcgacagcgccagccgtttgggcattaccatggcagccatcgacaacgccttgtataacgcctttggtcaacggctgatttccaccatttatacgcagtccaatcaataccgggtggtgttagagcatgatgtgcaagccacgccaggactggcggcattcaatgatattcgcctgaccggtagcgatggcaaaggggtgccactgaacagtattgccaccattgaagagcgctttgggccactgtctatcaaccatttgaatcaattcccgtcagcaacggtatcgttcaatctggcgcagggctactcccttggagaggcggtagccgccgtgaccttggccgaaaaagagatccaactgcctgcggatatcaccacgcgtttccaaggctcgacgctggccttccaggccgcattgggcagtacgctttggctgattatcgccgccattgtggcgatgtatattgtgctcggcgtgttgtatgaaagttttattcatccaataactattttgtccaccttgccgaccgcgggtgtcggggccttgttagcgttgatgctaaccggcaatgagctggatgtgattgccatcatcgggattattttgttgataggcatcgtgaaaaagaacgccatcatgatgatcgactttgccctggctgccgagcgcgatcaggggatgacgccgtatgacgctatctatcaagcctgtctactgcgttttcgcccgatcctgatgaccacgctggccgcgctgttcggtgccttgccattgatgttgagtaccggtgtcggtgccgaactccgtcaaccgctgggggtgtgtatggtcggtgggctgattgtcagtcaggtgctgacgctgtttaccacgcccgttatttacctgctatttgataaattggcgcggaatactcgggggaaaaatcgccatcgtgatgaggatattgactcgtctgagttgctgaacggacaggagccacagtgaaattcttcgctctgtttatccagcgcccggtcgccaccacactgttgacgctggcgatcaccctcagtggcataattggctttagcctactgccggtatcgccactgccgcaggttgactacccggtcattatggtcagcgcctcaatgcccggtgccgatccagaaaccatggcctcgtcggttgcgacaccgttggagcgcgccttgggaagaattgccggggtgaatgaaatgacctcgaccagttcgctgggtagcacgcggattattctgcaattcgatcttaaccgcgatatcaacggcgcggcccgtgatgtgcaggcggcgctcaatgccgcccagagcttgctgccgtcagggatgcccagccgcccaacctatcgtaaaatgaacccgtctgatgcgccgattatgatcatgacgctgacgtcagataccttctcacaggggcaactctatgattatgcctcgaccaaactggcgcaaaaaatcgcccagaccgagggggtcagtgatgtcacggtgggcggcagttctttacctgcggtgcgggtcgagctaaatcccagcgccttatttaatcagggcgtatcactggatgcggtgcgtcaagccatcagtgccgccaacgtgcgccgtccacaaggttcagtggatgccgcagagacacattggcaggtccaagccaacgatgagatcaaaaccgccgagggctaccgcccgctgatcgtccactacaataatggctcgccggtacggctacaggatgtcgccaatgttatcgactcggtgcaggatgttcgcaatgcggggatgtccgcaggccaaccggccgtcttgttagtgatcagccgtgaaccgggggccaatattattgccaccgtagaccggatccgcgcggagttacccgccttacgcgcctcaatcccggcctcaattcagttaaatattgctcaagatcgctcacccaccattcgcgcttcactggatgaggtcgagcgttcattggtcattgcggtagccctggtcattctggtggtctttatcttcctgcgttcgggtcgagccacattgatccccgccgttgctgtccccgtctcattgatcggtacgtttgccgcgatgtacctgtgcggttttagtttgaataacctgtccctaatggcattgaccattgccaccggttttgtggtcgatgatgccatcgtggtgctggaaaatatttcccgccatttggaagcgggtgtgaaaccgatggtggccgccctacgtggggtccgtgaagtgggttttaccgtgctatcaatgagtatttcactggtggcggtatttattcctctgctattgatggcggggctaccggggcgtttattccgcgaatttgctgtcacactgtcggtggcgattggcatttcactggtgatatccctgaccctaacgccaatgatgtgcgcctggttgctgcgttcacacccaaaaggtcagcaacaacgtattcgcggttttggtaaagtgctattagctattcagcaaggctatggtcgttcactgaattgggccttaggccatacccgctgggtgatggttgtgctgctttccacaattgccctgaatgtctggctgtatatcagtatccccaaaacctttttccccgagcaggacaccggccggatgatgggctttattcaggccgatcagagtatttcgttccaatcgatgcagcaaaagctgaaagattttatgcagatcgtcggggcggatccggcagtggacagcgtcaccggctttacggggggctcgcgcactaacagtggatcgatgtttatttcactgaagccgctcagcgaacgccaggaaaccgctcagcaggtgattactcgcttacgcggtaaactggccaaagagccgggggccaacctgttcttgtcttctgtgcaagatatccgagtcggtggccgtcattccaacgccgcctaccaatttaccctgttggcggatgatctggcagcactgcgcgagtgggaacccaaagtccgggcagcgctagccaaattgccacaattggcggatgtaaactcagatcagcaagataagggcgcggagatggcattaacttatgatcgcgaaaccatggcgcggctgggtattgatgtctctgaagcgaatgctctgctgaataatgctttcggccaacggcaaatatctaccatttatcagcctctgaaccaatacaaagtggtgatggaagtggctcctgaatatacgcaggatgtgagttcgctggataaaatgtttgtgattaacagcaatggtcaatccattccgctgtcctatttcgctaaatggcaacccgccaacgccccgctggcggtcaatcaccaaggcttatccgccgcttcaaccatctcatttaacctgccagatggcggcagcttgtctgaggccacggcggctgtcgaacgagcgatgacagaactgggtgtcccctccaccgtgcgtggggcgtttgccggtaccgctcaggtattccaggaaacgctgaaatcgcagctctggctgattatggcggccatcgccacggtgtatatcgtgctggggattttatacgaaagttatgttcacccgctgaccatcctctccactttaccgtcggcaggggtcggggcgttgctggcgctggagttattcgatgcaccgttcagcctgatcgccttaatcggtattatgttgttgattggtattgtgaaaaagaacgccatcatgatggttgacttcgccctggatgcgcagcgtaatggcaatatcagcgcccgcgaggctatttttcaggccagtttactgcgtttccggccaatcatcatgaccaccttagccgcactgtttggggcgctccccttggtgcttagcagtggtgatggtgcagagttacgccagccgctggggattaccatcgtcggtgggctggtcgtgagccaattactgacgttgtacaccacaccggtgatttatctctattttgaccggttgcgtaaccgttttagcaagcaaccgctgatgaaattggaatagtatgcaacagagtggaagtaggagtggggcgccatggtaacgcaagcaacatctgtgcgatggcaattgtggattgtcgctttcggattttttatgcagacgctggataccaccatcgtcaataccgccctgccctccatcgcagccagtctgggcgaaaatccgttacggatgcaatcggtgattgtctcgtatgtcctgaccgtcgcggtgatgttgcccgccagtggttggctggcggaccggatcggcgtcaagtgggtgttcttctcagcgattattctgttcaccttcggatcgctgatgtgcgcgcaatcagcaacactgaatgaactgatcctctcccgtgtgcttcagggggtgggcgacgcaatgatggtgcccgtgggccgcctgacggtgatgaaaatcgtgccacgcgagcaatatatggcggcaatggcgtttgtcacactgcccggccagattgggccattagttggcccggcgctgggcgggtttttagtggaatttgccagttggcactggattttcctgattaacctgcctgttggtgtgatcggcgcattggcgaccttgctgctcatgcctaaccacaaaatgtctacccggcgctttgatatcagcggctttatcatgttggcaatcggtatggcgaccttaacgctggcactggacggccacacgggactggggttatcgccgctggccatcgcggggttgatcctgtgtggcgtaatagcactgggcagctattggtggcatgcactgggtaatcgtttcgcactgttctcactgcacctgttcaagaataaaatctatacccttggtttggtcgggagtatgtctgcccggatcggcagcggcatgttgccatttatgacgcctatctttctgcaaatcggcctagggtttagcccattccacgcggggctgatgatgatcccgatgattatcggcagcatgggcatgaagcggattatcgtacaggtcgtcaaccgctttggttaccggcgagtcctggtcaacgccacattattactggccgtcgtcagcctgagcttaccgctcgtggcaatcatgggttggacactgctgatgccagtagtgttattcttccaaggcatgctcaacgcattacgcttttccaccatgaataccttaaccctaaaaacgttaccagatcgtctggctagcagcggtaacagcctattgtcgatggcgatgcaactgtccatgagtatcggggtcagtactgccggaatattattgggtacctttgctcatcatcaggtagccaccaacacgcctgccactcacagcgcgttcttatacagttacttatgtatggcaatcattatcgccctacccgccctgatatttaaccgcgttcccccggatacaggagccaatcgtcatttggcccgctagattggccgactgataaagacaggtgaaattatgataaggatcggcattaccggaaaactgtttatggctattttcgccacttgcatgttggtattgataaccatgcactggggcgtcaggaccagttttgaacgcggtttcattgactacatcaagcaaagtaatgaacagcggatcgccatgctaagtcatgcgcttgaaggcgaatatcagcactacggtaactgggattttctgcgtaataatgaccaagtgatttaccagatcatgcgatcctttgagcaaaaccaaaacagtgagaacagacccagtatgccgccccgtggctggcgcgcccaattttgggtggttgatcaagacaataatctgctggtcgggcactccgggcatctccccacagaagctagccgcagtgccataaaagtcaatgatcaggttgtcggctgggtgatttcgaccccatcggaaaaactgacccgtaatgcagatatcacctttgatcaacaacagcgccgcaccagttggtttattgttggcctctcgacgctgctggcggctgccgtcacatgggtgctatcacgcggcatgttagccccagtaaaacggctggttgaaggcacgcatcggctggccgcgggggattttagcacccgtgttgccgtcagtagccgcgatgaactgggccacctggcacaagattttaaccagctagccagttcactggaaaaaaatgaacaaatgcgccgtgattttatggccgatgtctcccatgaactccgcacgccactggcagtattacgcggagaactggaagccttacaagacggcctacgccaacccacccccgagtcattaagttcgctccaagccgaggtggcgattttgacaaaactggtcaatgacctgcaccagttatcacagtctgatcgcggggcgctggcttaccgtaaaacccaactggatgtggtccggctattgcaagtggcgattgccagctttcatggccgcttccagaacaaaaagatgaccatcaccgcccacctgcctgaacacgcggttatttttggcgaccctgaccggctcaatcagttatttcacaatttactggaaaacagcctgcgttataccaacgaggggggggcattagaaattatcgcgttgatccaagaagagacactcacgctgcactggcaagacagtaaaccgggggtcagcgatgaacagctcgagcgcctttttgaacgtttttatcgtacggaaagttcacgtaatcgcgccagtggcggctctgggttggggttggcgatttgccacaatattgtcgatgcgcatggcggaaaaatcagcgctaaacattcacctttgggtggcctgcggattacggtagtattccccctatttcattccatagggtaatccattgtaatgcacgagtcgcttctgtctgccagccagtctggctctgtattgatcgttgaagatgaacccaaacttggccagctactcgtcgattacctgcaagccgcgggttaccgcacccagtggctgaccaacggggccgaggtcgtggcaacggttcgccaaacgccacccgccatcatcttgctggatctcatgctgcccggcagtgatggcatcaccctatgccgtgaaatccgccgtttctctgatattcctattgtcatggtgacggcaaaaacggaagagattgataggctcttggggctggagattggcgctgatgactatatctgcaagccctatagcccacgggaagtggtcgctcgggtcaaaaccattctacgccgctgctctcagcaacgtcatcaacccaccgatgacgcaccactgctgatcaatgaatcccgttttcaggcgagttaccaagggcatatgctggaattaaccccggcagaattccgcttactgaaaatattagcctcccaaccgggccatgttttcagccgggaacaactgctgaacaacctttacgacgattaccgggtagtgactgatcgcaccattgacagccatatcaaaaatctacggcggaaactggaattactcgatggcgaaaaaccgttcatccgcgcggtatatggcatggggtatcgctgggaagcagagatgtgccgtttgttgtaattctgtttttgccataggtgcgctatgttggcggtgttagctcgttatgtttgcgatgcacggagcacattgacctgacttccggtcaaccttgactacactcattagaggtatcacatgcaacaggagaaacactatggccttgggtcactatgagattaagaaagcaaaaaatgggcaatatcatttcaatctgaaggccagtaatggtgaaattattctctccagtgagatgtacgccagtaaggcctcagcggaaaatggcatcgcatcagtacaaagcaactccccgcaagaaagccagtacgagcttaaacacaacacaaaaaatgagccttatttcgttttgaaagcgaaaaaccatcaagttattggcgtcagtgaatcctacagttccccaaccgccgccaagaatggtattgcctccgtcatgaaaaatggcctgtctacggttatcaaagatttgacgctgtaatgtttcttgattagacgctgtaacgtttattgattagatgccgtacatttattgattagatagaataacgaccacttatccctgcgcggggccattaaccgcgcatttcatttttgcacgacaagacgaatgggtgattgaggccccacaataatcggttgaattgatctggatcatttaaaccttacaaaaattgtgcgaaggctgattttcacccttggcgaggttacaatcctcggcttttagccacccctacgggcgtggttctgacttgaactcagactgagagccactgatatgtcttcatcatcatttacaacggaaagaccctttacaccggaattgttatcccccgccggtaccctaaaaaacatgcgatatgcttttgcttatggcgctgatgcagtctacgccggccagccacgctatagtttgcgggtccgtaataatgaattcaatcatgaaaacctggcgttaggtattcaagaagcccatgcgctcggcaagcgtttctacgtcgtcgtgaatattgccccgcataattccaaactgaaaacctttctgcgcgatttaaaaccggtgattgagatggggccggatgcgctaattatgtccgatcctgggttgatcatgatggtacgcgacgctttcccacagatggatattcacctgtcagtgcaagccaacgccgtcaactgggcaaccgtcaaattctggcagcaaatggggctaacccgcgtgatactctcccgagaattatcactggaagaaattgctgagatacgggctcaagtgccagaaatggagctggaagtctttgttcatggtgcattgtgcatggcctattccggtcgttgcctgctctctggctatattaataaacgcgatccaaaccaaggcacctgcaccaatgcctgccgctgggaatataacgttcaagaagggaaagaggatgatgtcggtaatatcgtgcacatccaccagcccattgcagtgaaaaatgttgaaccgacgctgggtatcggggcgccgactgacaaagtctttgtgatcgaagaagcacaacgccctggcgagtacatgaccgcctcagaagatgagcacggcacttacatcatgaactcaaaagacctgcgtgccatccagcatgtggaacgcctaacccagttgggtgtccattcgctgaaaattgagggccggacaaaatcgttttactactgcgcccgtaccgcacaggtgtatcgccgtgctatcgacgatgccgttgccggtaagccttttgaccccagtttgctgaccacgctggaagggttagcccatcggggctataccgagggttttctgcgccgccacgtacatgaagagcaacaaacttacgaatacggctattctgtttctgagcgtcagcaatttgtcggtgaattcactggtgtgcgccgcgagggtttagctgaagtgctggtgaaaaataaattctcacggggtgatagcgtagagttgatgactcctaaagggaatatccaatttaccctagagagcatgcaggataaaaaaggccaacccgccgatattgcaccgggtaatgggcatatcatgtatttacctattcccgaggagattgatgtggaatatggcttactgatacgtaacttaaacggaacaaatagccgcaatccccacgaaaaagcgtaacgagattcaataaaatgaatgccacagataaagtggcattttttagtaaatattagaaatagatcacatcaattataatagcagtcggatagtatagtccgagtacaatcaataactaaaaaagtgttaagtaatactaggaaccacctccttggctagcccaatctcccttgggctggccttttcttttttttcctcacatctggctgatacatatcacctttatcctttctcgtaatattagccattcctgttagacgattccataatattaagaaaaatctgttttaatgaataatttattcctaaaataataattatcccaacagaacaaatatcacattagaaatacatacctattttattgtgctccctattggcaacaattccctgttattccttgaataatctgatagaagaattaagcagatatgctttactgtaacgactgtccctaaaattatgggtgttgtcgtaaggcactcagtagaggtaaggcagtaagcagaggcaaggcccatgaatgagccgagtcacgagtgcagctaatttttcaccgatacaagcctcatcgatacaagtactgctgcagcaccaagaatgaagggactcccatataaatgatttggagcacatatgccacacactcttttgatcctcaacggcaaagaatcaggcaaccctgaggtccgcgaagcggtcaaaaacgtacgcgacgaaggcttaacgcttcatgtccgtatcacctgggagcacggtgatgcaaaacgctatgttgaagaggccgccaccttggctgtcagtaccgttatcgctggaggcggcgatggcaccattaatgaagtggcaacagcattgatgagtttacctgcggataaacgcccttgtctggggatcctaccgctgggaaccgccaatgattttgcgactggctgcaatatccctttgcaaatagagaacgcactgcaactggcggtcaaaggccgggcggtggcaatcgatctggctcaagtcaacggtgagcattactttatcaatatggcaaccgggggttttggtacccgaattaccaccgaaacacccgataaactcaaagcggccttgggcggagtctcttactttattcatgggctgatgcgccttgatgccctaaaagcagacagctgtaaaatccatggccctgactttcattggtcgggggatgcgctggtcattggcatcggcaacggtaaacaggccgggggcggacaacttctttgccccgatgcactgattaatgacggcctgatgcaattacgcctactgacagcaaaggagttactccctgcagtgctgagtaccctgttcaatggtgagaaaaataagaatgttatcgacgccacggtaccttggctcgatatcactgcaccgaacgatatcaccttcaatctggatggtgagccactgtccggcagatatttccacattgaaatcttaccccatgcgattcagtgccggctaccaccgaattgcccgttgttaggctaaacgccacttagccctacacactcagtgccatctggaggacggcgggcgacgagtgtagaacacgataaatgaatgataaaacgtgtgaaatgcggcagaagaaaatgaagcacagtagatggaaacggaacccagcagataagaatgaaacagagtagataaaaatgaaacagagtaaataaacagcggagcacggcgagaaccgcccttgtcttgctccgccattggcgattcggggcattgttggcaataagtcatcactcataagagtcatgacgtgcaaaactcagcgccagttaggatctttctctagctgcgcggtcaacatggcctggatattctcattggggcgacccagccactgataagtcgcaaatttacttgggttatccaacgcctcgggcttgtcagccacggtaactcgcaggccccacacgtgctttttatcgttgctaaacgccacccacataaagttattactgcaatcgtgaggcttacagagactccccactttatattgctgtgcgccccacgtgatgttttcataaggccctgacgttcccgcccctttacgtgcccatgccggcaaatttttctgcccctttaccattttttgccaacgggctttatagacaggttgctggagaagttcagccatggtgggcgttgaggctaccggctcaggtacggtaaccccaggggatgagaccactgctgctggctgtgcaaaggagccagagctgatactcaataatattcccgctaaaagacaatggaggtttttttggcctttcattatcgaattccttttttatatgattaatcaacgcgtcaggcagtgataaagggggacgctgttcagcggacttgaatgcgccatgtgatgtcgcgtcgccttatatgaccatcaattgcgacaaaagttgatccattgcacgaatttctcatttcaattttagttattccgcaatcggtatgacaacttgagttaagctatgaaccagataatgttcagaaggccatgccatgttacccattgagttacccgaagagcctgaaaagctgtattactccgcaggggaggcccacccattggccaaacttgagacggataaaatccgccagatggtgattgatttagacgttgccaattctgatagtgagcattatgtcacgggttggatggggttaaatagcatcgtcgtggtgcgtaattatcaaaacaaacgcggtaccgcgaacggttttgtcattaataaaggggatcgctaccggctgagcattcagtctattgaatttcgcatccccaaaatggtgttgtggatgagctttcgccgcaaaccacgaaccatggaattgatcacctacgaagaactgggcgaaaaaccaagtggcatgcagcaatatcgcaatattcttgatgaagagttacttgggcagttagatcaagattggcacgaactgaatgactatctgggtgcagcctgctggcaactggagaacggcacccctctgtggcaacaactccatcaacagattacccctgatgctattcgtcagttagccaccgcccctattttccgaaccaaacatttgcaggccgatggtgaatattcaggcttctgggcgggggagtacttctttgccgtcaggcaaccgggcaccaagcaagccgccgataatccattccctgcggtgcaaatttcctggcgggaaaatgataaagatatcggcagttatcagttcgatctcattgaaggtgaatcgggcgaatcaaggctctcgctgtgtattcgtccgcgcaaaggtgcaaacagctacctgcttaaccgttttgatgcccaccatctgcaacgtgcgatagccatgtttactctggcacagcaatatttgtcgggaccagccactggcgacagcacggcgacgccagagcgtaccaatcaataaacccacctgcaattttcatcattttcattaccaccattgatgaaaatgatgaacaggcccaacgccctgccccacctccagggtatcggcctgttccagcgcacgttgcaaatagtgtttagctaccgccaccgtttccccccaatggccgtatcgcgggcgcagtgctgccaatgccgccgatagcgtacaccccgtaccatgagtattccgggtagccacgcgttgagccacaaaacgctgctccccctctgcggtaaacaaccagtctgggctatcctcgccggttaagtgcccgcctttcattaacaccccctgacagcctaaggctaatagcgcccgtccctgctcacgcatttgttgttcattgcaggccggtggacaccccagtaacgcggcggcctctggcaaattcggcgtaattaatgcgacttgcggcaacagccactgacgaacggcctccacggcgtcaggtgccaatagcggatctccacttttggccaccatcaccgtatccaaaaccacgaacggaataggataacggcgcaactgctcggcgaccatttcgaccaccgcagtattcgccagcataccaattttggcgctgtcgatacgcacgtcactgagaacggaatccaactgagcggcaacaaaatgaggatcgataggataaaccgactgcacaccacaggtgttttgtgccaccagcgcggtaatgacactggtaccataggcccgtaaagcagagaatgttttcagatcagcctgaatacccgccccaccactcgggtcagtaccggcaatcgtcagtgtattaatgcgcttcatgaatacgtctccgtactcatcattgagggggctaatggcgtaaattcagccgcagtggctgaaaagagaacggcaggtagaacgtacatattccctcctaaccggcggtcaagaaggcggaaccctacggtgccgagacttccctacgctggcataatccagatcaggtaatacgggtcatctctcagccttaccaccgcattgtggcaggcaccccgagtcagaatggtcattatcacgggcgggcagcagaagatcaatgatgtattaatcacaactataattcaccacggatattagagagagcccccttcaggaagagaggcgattgaacagttctcacccaaatggtattggggccaaataacgccacaggtttgacacaattggcgacaatgggactacaagcctgtaggaaaattttgaatattctataaatgaagtaaatacccttgcattgagtctgtgtacatagaagactgtttaacttgtacctatggaagtaaccattgagattgacgatggccgtgatgatactaagaaataaaaatttttcacttctctcgttgctgctcatatctgcactaatttattttttatggatggaattcaaaccggttaaaatcattgcaattcaccagcaagataattttagcgatgttttagtaaataatttccctattactgataacggaaaaatagcttggtggatgaaaaataaaaacatgctgtcagacaagtataaaataccaaaacccgcatccgatggtttttttactattactttctgggatttcggtgatggctatcaagaggaaggtaaatatgacagattgtgcttcgacgatatgaaaaccgctgaggattgtatagataaaaattcatttcttacagtaagaaacacacctgacaatagagtattttttattgttgacaatggtaaatacttacttcaagagaataataaggtgattaaggtaagagagtagccaacgcacatacagattgaagtatgacagatataaaacatattaaagagggatctgaatgacatataaaaagtataactccagttgggaaggctacatgggggatgttttaaacggtaatgttggcattaaccagctaaaacctcaacatgagtattttgatgctatagggctaggaaaggtattaagtgagaatacacaataccatgcagttctcacattagcagaagccaaaagtattattgaagatattaatcctcctcggacacaaagcccaagtaacggagaagcactggcacgaggatttgagataggaaataaggttactaatcctgtggcgcgggtgttttccgttaccgatcctatttctgcttatgccggaaatatctacgactcacggggagtctatgatgttatccgagaatttaagcgattcagcatcaccgcgacagagtatgtgggcgagaatgggcgtaagtatattcacatttctggctatgccggccttaggcgtattatcacaggaacccgttatggtgccagccacccacaaatgctatcaatgggaatcggccagcaaggtctcagttccaatattgttaaaggtctaaaattctgtattctcttttctattggctatcgaacgattgaaggtatctttaaagatgaatataccttagcggaatttatcggcaatataacgatggatatggctaaaatagccattgtcgcggcgacttcttttattgtaggtgtactcttcactgcgacagttcttgcaggtggcagtattattgtcgttgctggggtagcttttgccgttggctttgtagctaccgctatcctagatcatttcgatgaaaagtatggtataagtgaaaaattaatcgcattattaaccaaagaaatgagaaaaaaaccaagaacacaagaagcaaactttcagtctattcttaatggattagggcgacttaaatgaataatagattatttaaaacattaggtgcaatcatagcattattaatatttacgccaatgatatatttagtgagcacttacatcatttcattaataaaaatggaagacataataaaattctccggacctattttcatagctttcctatcatcccctatactactttactctctcgtaggatctgtttggttttttatctttaataagttacctaaatttaataaatttattattaagtatttatccataccaatgtttttatcatttatcgtcagcttccctatttctttatatgttgattacaaattaaaaagtaatggttatgtggtatgtgacagaatttcatggatgtcgccgaatacttatgtaaaagacttatcactttgtagataaatataaaatattcaacagaaaaagataattataaatacagtaaactggaaccgagtaattaagatgaaaaatagacctttcaacattctatttggaatgataatattttcaatagttttatttatgatgtatttggtttttttatgtataatttcattaattagaatggaagataaaataacattttcaagttctattgttatatgtttaatttcgtctcctctattattttatgctaccgcagggtctgtttatatttttgtatttaataaaaaacctaaatttaacaaaatgattgtaaaatacttaactatgctagcaatagcatcattcatcattagttttcctgtatctttttatgttgataataaattaaaaaataatggctatgtggtgtgtgacagaatttcatggatgtcgccgaatttttatgtaagagatttatcactttgtagataaatataaaatatttaacaagaaaataattttaaatacagtgaagtggatcaggatgattgagatgaaaaatagattacttaaaacattaggtgcaataatagtattatcaatactcacgccaatgatgtgcttagtgaatatttacattattgaattaataaaaatggaagatgaaataacattttctgcttctatttttatatctttcatttcatctcctcttgttttttatgctctcgtggggtccatttatgtctttatcttcaatagaatgcctaaatttaaagaaataattattaaatacttggctatgctaatgattgcatcatttatcgttagtctccccgtgtctttttatgttgattacaaattaaaaagtaaaggttatgtggtatgtgacagaatttcatggatgtcgccgaatacttatgtaaaagacttatcactttgtagataaatataaaatatttaacagaaaaagataattataaatatagtaaagtggctctgggtaattgagatgaaaaatagattatttaaaacattaggcgggttagtttttttactttcatttctatttctgatgaaatacttaattattaactctataattccactaataaaaatagaagatagaataatattctctagctccatagcaatatgccttatttcatttcctttaatgttttatgttatgacaggatcgatttatttttttattttcaataaaacacctaaatttaacaaactgcttataaaatacttaaccatgctagcaatagcatcattcatcatgagtttccccattcctttttatattgactacaaattaaaaaatgatggttatgtggtatgtgacagaatttcatggatgtcccctaacacttatgtaaaagatttatcactgtgtaaataacaactttaaatataaggaattgtatggctaacttaatttatgcaagtattgatggcgaaaaacaagggttgatatcgtctggctgctcaacgcttgactctattggtaatcgatgtcagttggggcatgaggatcaaatatatgtctatgggtttgatcataatatagccagagcacaaaatgtcgcgcatcagccaatcataataaccaaacccattgacaaatcatcgcctttgctagggatgtctatatcgaataatgaaaaactacaaatagtattatatatgtacagggtaaattcatcgggttccttagaggtgttttatacaataaaactgaaagacgcctatatctcaaatatttctcaacattgcccaaatgcgctgacacataatgatattcagccctatgaaatcatatcaatttcgtacaaaagcattgattgggagcacaatatttctgggacatctggctatagcatatgggatgaaagagtttattgatttttaagtgacggccataggcatataccctatatcgttaaaaaccataaaaaaaaccgcctaatatttaaggcggtttcagactgctggcaaagtcaattgaaggggaaacgtgccgttggggtcgtagtggcgtaagccaccggagtgcccctaggtgcggtcaacccttcattcaccaagctaaaatagcgttgtcaataacctcaaaccgcctaatattcaaggcggtttttgctattttcaatcgttatcaaccatggttaaaaacgataaaatcattcccactcaatcgttgcaggtggcttgccgctgatatcataaactacgcgcgagataccattgacttcattaatgatgcggtttgaaacgcggccaaggaagtcgtatggcagatgtgcccaatgtgcagtcatgaaatcaaccgtctctaccgcacgcagagagacaacccaatcatatttacggccatcacccatcacaccgactgaacgtactggcaggaagacagtgaaagcctggctaactttattgtacaaatcagctttatgcagctcttcaataaagatagcgtcagcacggcgcagcaaatcgcaatactcttttttcacttcgcccaatacgcgcacacctaagcccggccctgggaaaggatggcggtacagcatgtcgtatggcaggccaagctccagaccaatcttgcgcacttcatctttaaacagctctttcagcggctcaaccaggcccagcttcatctcttttggcaaaccgcccacattgtggtgagatttaatcacatgcgctttaccggtagctgatgcagccgattcgatcacatcagggtaaatcgtaccctgtgccaaccatttcacctgctcttgtttacaggcttcttcgtcgaagagttcgacaaagacacggccaatgattttacgtttcgcttctggttcgtccacacccgccagtgccgaaaggaagcgatcctctgccgccacatggacaatattcaggccaaatttatcgccaaacatttccaagacctgatccgcttcgtttaagcgtaataggccgttatccacgaatacacaggtcaggcgtttaccgatagcgcggtgcaacaacatggccgtcactgaagagtcgacaccaccacttaaccccaagatcacatgatcgtcgccaatttgctcacgcaaacggacaattgcatcttcgataatggtggcagatgtccatagcgcttcgcagccacagatacccagcacgaaacgctccaacaaacgcaggccttgcttggtgtgtgtcacttcaggatggaactggacaccataaaaacgtttttcttcgttagccataatggcaaacggacaggtatccgtgctggcaaccgtgacaaaatcagcagggatctccgcaactttgtcaccgtgactcatccaaacatccaatacggcttcgcctgccggattgatggcatctttgatatcacggatcagcgcgctgtcagctttaatttcaacttgcgcataaccaaattcacgctgatttgaactctcaactttaccgcccaattgtatcgccatggtctgcatgccatagcacacacccaataccggtacaccagccgtaaacacatagtctggtgcacgcgggctaccgttttctatcgtactttcagggctaccagagaggatgataccgcttggattaaattcacggatttgggcttcggtgacatcccatgcccatagttcacaatagacaccaatctcacgcacacgacgcgccaataattgggtgtactgcgagccgaaatcaagaataaggatgcgatgcttatggatattttttgtcatgtgtggcgtattccaaaaatacccttcttacttgacattaccgtggtgcgagcacgaatcactgacttcgagacccgtttatttgctgccttactgcaacgccaatgactttgggtattgattttaaaataaaaaataaccatctgatggccagcaccagatgattatttaactaattgttacatcatacgataattaggtgactctttagtaatcgtcacatcatgcacatggctttcttgaatgccggcaccactgatgcggacgaactccgctttagtgcgcaattcattgatagtgccgcaaccggtcagccccatgcaagaacgcaggccgcccatttgttggtgcacgatctctttcagcaggcctttgtaggctacgcgcccttcgataccttcaggaaccaatttatcggccgcattatcggtttggaagtaacggtcggaagagcctttggacatcgcgcccagcgaccccataccacggtaagatttgaaggagcgaccttgatacagttcgatttcgcccggagactcttcagtaccggccaacatagaaccgaccatgacgcaagaagcccctgcagcaatcgctttggcaatatcgccggagaaacggatacccccatcggcgataaccggaataccggtaccttccagtgcttcaacagcatcggcaatcgcggtaatctgtggaacaccaacaccggtaacaatgcgcgtcgtacagattgaacctgggccgatacccaccttaaccgcactcacaccggcatctgccaacgctttcgccccagcaccggttgcgacgttaccgcccacaatttgcaagttaggatatttagcgcgagtttcacggatacgttgcagaacaccttcagaatgaccatgagaggagtctatcagtaatacatcaacaccagcggcgaccagcgcgtcgatacgctcttcattgccagcaccggcaccaacagcggcaccaacacgcaaacggccatgctcgtctttacaggcatttggcttacgttctgctttttggaaatcttttacggttatcatgccgcgcaaatgaaagctgtcatcaacgaccaacactttctctacacgtttttcgtgcattttttgcagcacaacttcgcgggtttcgccttccttgaccgtcaccaagcgttctttcggtgtcatcaccgcggtcaccggttgatccaaatcagtcacaaagcgaacatcacggccagtgatgatcccaaccaattcgtaatcttcggtcaccaccggatacccggcaaaaccgttacgggcggtcaattctttaacctgacggagggtcgttgttggggtaacagtctgtggctcagtaacaacgccactttcatgttttttcacgcggctgacttcttcagcctggcgctcaatggacatatttttgtgaatgaaacccaaaccgccttcttgtgccagcgcaatggccagacgagattcggtaacggtatccatggctgcggacagcataggaatattcaggcggatagttgcggtcagttgagtgccaagttctgccgtgttaggcaagactgtggagtgggctggaaccaggagaacgtcatcaaatgttagtgcttctttcgcgatacgtagcatgggcaatatctcaccaaggtgaatgtgaaaaagataaaatattgccgtggcattatacagagcgtaatcgattgcctccagcactttctcataatatttcttgccaaccagtttgaggcaggtaatatcggttaattaagtccttgttttaaaatttgatccaggtcacatgtcgcaatcttccgcctcctcaatttttactgtcagccgcctgaatcagacggtacgagaactattggaaagggaaatgggccagatttggctcactgccgagatttctaatttctctcagcccgcttctgggcactggtatttcacgctgaaagatgatcgggcgcaagtgcgctgtgccatgtttcgtaacagcaaccgccgcaccactttccgtccgcagaatggccaacaagttttggtcagggcatcaattaccctgtatgaaccccgtggtgattatcagttaattgcggaaagtatgcagcctgccggtgatgggttgctgcaacaacaatttgaacagcttaagcaacaattagcggccgaagggctgtttgatcaaagccacaaacagccactccctagccccgccaaacaagtgggcgtaataacgtctgccagtggggctgcgctgcatgatgtgctgcatgtgttacagcgccgtgatccatcgcttccagtaattatttatcccacatcagtacagggcgttgatgcgccattgcagatagtccgtgcgatccagttggcgaacttacgtgctgaatgcgatgtattgattgttggccgcggtggcggatcgctagaagatttgtggagtttcaacgacgaacgggttgcccgcgctatctttaacagccatatccctatcgtcagcgctgtcggccatgaaaccgatgtcactattgccgattttgttgctgatttacgcgccccaaccccttcggctgccgccgagctagtcagtcgcaatcagattgagctcgttcgtcagattcaagggcaacagcaacgaatggaaatggcgatggattactatctggcgcaacgcaaccagcaattcacccgccttgaacaccgtttgcagcaacagcatccgcatttacgtttagcccgtcagcaaacattgttgctgaaattacaacgtaggctggaagagagtgcacaaacacagatccgcttattaagtaaacgtaccgagcgactgcaacagcgtttgcagcaagtgcagcctcaggggcaaattcaccggtataaccagcgggtacagcagcaagaataccgtttacgtcaagctgtagagcgccagctcaatggctatcgccaacgctttggtatcgcctgctcccagctagaggccgtgagcccactggcaacactggcccgtggctacagcgtgacacagacgccagcaggggcgttattgaagaccaccaagcaagtacaggccggtgataaactgaccacccggttgcaagacggttgggtggaaagtgagattacccaagtcaccgtagcgaagaaaagccgtcagaaaaaagtagtgacgcagtgacgcagtgacgcagtgacgcagtgacgcagtgacgcagtgacgcagtgacgcagtgacgcagtgacgcagtgacgcagtgacgcagtgattatagcggcaaggatggggctgccagtaaaaccatcagcctctaacactctttcgttgatcatttccccacctgataagccgtcagcttaccggtaagtaattgaagtggatacgccgttttgagattaatccatgtccgtgttggcaaaaataatcaacggcaccacaggctttcaggacttgcagaggttgcgcacaatcagggcactctgcttgttgttgatagttaccatggcaggtctcgcaatgaaagtggccactcacctcagtcatcgccttctggcaaaccggacataatgcatccactttttctctcctatatctcagttgaaacccacatatctccgttgaaacctacatcacacccagcgaacgtaaaaagtagatccctaacgccgtggtgaaaaatgagccgaccgtcgtaatggcgataatattggccgccaaggtcgcattgcctcccattgctcgcgtcataacatagctaccggcagcggttggggtggcagaaaacagaaagatcacccccagcgtagcaccacgaaaccccatcagtaagccacccaatgtcatcaatattgggactaaaaataattttgccaccgaggatagcgctgccacattggaagaacgaaacatcgcatgccaatcgaggctggccccagtacagagtaacgccaagggcaatgccagagcagaaatatagctccccgtttgcacaatgacctgcggaagcgataaggcggtttgggcaaagagtaggccacagactaagccgataatcagtggattcgtaacgataccgcgtaagagcgataatttgctgattttgccaccctgccccgcttgcaggctacgggtcagggttaccaccgacagcgtattaaataaaatcactgtcaccgtcagatacatagaaccgatcgcaaccccttcggcaccataggctgtcatggcaaaagctaaaccaacaatggcagtattggccctaaaaccgccctgaacgaacacaccacgctctctcgggtcttttaccaaccatttggcggctacttcgagcagtaaaaaggttagcaaggtcccccccgctccgtagatagctaacggcaggttatccagtaaacctacgtgattggtagcgacactgaaaaacagcagacacggcagcgctaaattgaagactagccgggtcgcaccatcgcagaaattatcatcgattaagcgacagcgccgtaatagcacgccgagtaacatcatcagtaagttaggtaccgtgacactgaatgcgaaactccaggtttcccaagacatggctggctctcaactctcttttctttaaacggccagcggccaacacatctgcaacttggatgtcacttgggtatataactatttatatttaggtatataactatttatatataaaaaacaggttatatagagaaaaaaaccaggctactgacaaaccccgatgacgcgatcttgaacggtgaggataggcagaagagtaaagtgtccgcgccagagatggcgcggctcaagctcccaaggaagctatttttatacagggaaaccggcgtctttacttactgcccgttctctccgtcgcgggcactttgccaataacctcagcgcggggtatccgctctatcttgaattacttaccttttttcagatgagacatcaaacgtttacgtttacgcatctgattaggtgtcagcgggttgcgcttaccggcaaacgggttctcaccctctttaaactgaatgcggattggcgtccccataactttcagtgaacgacggaaatagttcatcaggtagcgtttgtaagaatctgacaggtcagtcacctgattaccgtgaatcactacaattggcgggttatagccaccggcatgggcatatttcagcttcacgcgacgaccacggaccaacggaggttgatggtcttcctctgccatttgcataatacgggtcagtaaggaagtacccactcgcttggtagagcaatcataagcttcctgtaccgattcaaacaggttgccgacgccgctgccatgcaaggctgaaataaagtgaatgcgagcaaaatcaacaaagccaagacgcaggtccagcatatcttttacttgcgcacgggcttcttcagtcatgccatcccatttgttaactgcaataacaagtgagcgcccactattgagaataaagcctaatagcgatagatcctgatctgaaattccatcacgggcatcaataaccaacaggacaacgttagagtcttcaattgcctgtaacgtcttaatgacggagaatttttcaaccgtttcagtgattttaccgcgcttacgtacacccgccgtatcaatcagaatatattcacggtcatcacgcgtcatcgggatataaatgctatcgcgcgtcgtacccggcatgtcgtaaaccaccacacgatcttcaccgaggatacggttagttagtgtggacttacctacgttaggacgccccactatcgccaatttaattggcaaagtccgcgggtcaaaatcatcttccggatcttcaggcggaacatcttcaccttgagcttcctgctcagcccaataggccgcattttcctcttcatcggtcaactcaacttcaggttcctcggcatccatataaggtgccatgacatcttcaatcagttgagtaacgccacgcccatgggaggcagcaatagcgtgaacttcgcctaaacctaaagagtagaaatctgctgtagcagtatcaggatcaataccatcggttttgttagcgaccaggaaagtggctttttcacggctgcgcagatgttgagcaatcccctgatctgctggcatcaagccagcgcgtgcatcgaccataaacaggacaatatccgcctcttcaatcgccaataacgattgacctgccatcttggtttctacaccatcttctgtgccatcaatacctccggtatcgacaacaataaactcatgcccttcgacctcggcacgaccatatttacgatcacgcgttagcccggggaaatccgcaactaatgcatcacgggtatgcgttaagcggttaaataaagtggatttacccacattcgggcgcccgaccagcgcgatgacaggtatcattgttgaagcctcattacttaattttcaaagcgttacagcgctgcatcgaaccttcaacagcgcagtttttagaatacaaacggcccctgagtcccaggagccgtttttgaggtactggcctgtcaaacaacaggcgctaaatcagaattaacgggtgaacgcgtataccgtaccgcttcttgcctgaatcaacagcttatcgctggcaaccactggcgcactcaggaaacctgagctgtccacgctctgttgagcaacaaaacggccatcatcggtattcacccagtgcagataaccttcggcatcacctacgaccagatagccattatacatcactggagcggtcaagttacgatgcaataaatcgctttgactccaaagcgttacgccgccatcagacttcagcgcgattatacggtcattttgatcaacgagataaatgcgcccagcgtcaacaataaagtcattcacggagcctatctcgcgcttccacaggatctggccggaacgcaaatccaaggcggttagattaccgttataagccaacgcataaaccacaccgtcaaccacgacaggcgtgatatcgatatcattcaagcggtcaatttcagtagcaccggtcacttgtgagatacgttgttgccagatcaactgaccctgttccatcatcactgcactgacccggccattgtcaccaccgacaatcgctgcaccaaatgcaaccgcaggggctgactcaccacgcagagacaatgcaggcgtatccagatttagtgtccacttgatagcaccgtcagactcattcagcgcttgcagcataccatttgatgtgtggatcagtactacgccatcgctcaccacaggacgggacaacgcctcacccgcaacgaccgtctgccatgcaacctgaccatcatcggcattaagcgcgtaaaccaccgctttttcactgccaacataaacatgcgaacctgaagctgttacgccaccagataacatcgcagaatggttgctggagagaaagttcgttttttcagacaggtcggtttgccagatttgcttaccggtgtctgcatccatggctttcactaaacctttgcgatcggcagcaaatacggaagtcccctgccatgctgggcgcagatgggagtaataatcaccaacaccgctcccaacagaggtgctccacaccttagttggtgagaattgattttcaacctttggcagtggtgacatggtaaccacatcttcttcactgttaaacagtgagcaaccactcaatagggcaacagataccagtcctactaagagtgttttacgcaattgcatgggaataccccttagctggacaagttattcagtttcatacgcaacaatgcttgcagcgcctgagaagcattagattcgatagctttactataagcagcgcgcgcacctgcggtatcacctttgcttaataatgcatcgccacgaacatcttgagccatcgctgtccagccatcaccttgtactgcatccagcgttttcaatgcttcatcgggttttttcagttgcagttgcacacgcgcaaggcgcagattaatcagcgacaacagattttcatctttcgtctggcccaaggcttgactgagttgctgtgccgctttatcgaatgcattttgttcaacaaaatcatgagccagttctaacccgacgagtacgccgtagttatttttattgctctgaacaaacttttcagcgagagcaatgctatcagcactaacattacccgcactgttagttgacagagcagtactgactttctgataggcagaggaggcttccgtcatggcagtattctgattaccctgccaataacgccaacccactaatgcaccaatcccgagcaccacacccacggccagtgctttaccattttcactaaagaaacggcgcactgcatcaacctggtcattttcagtggtatagacttccacggtgtctctctccttaacccaacatcaaagccagacgcgcagcaacatccgcttgcgccagcgtttcttgttcaccatttcgcagatcttttacaacgacttgctgcgcggccacttcgctttcacccagcattaaagcgacacgagcgccccacttatcagcgcgtgtaaattgtttcttaacattaccgccaccgtaattggtcattatttttagcgttggtaaggcatcacgtaggctctcagcaagtagcatcgcagcactttgcgccccctcaccggaggagataacataagcatcaactgtcgcaggcacctggaaatcagcattaacagcctgcaccagcagaaccaagcgctcaaggcccatcgcaaaacccacggccggtgttgcacgaccaccgagttgctcgaccaacccatcataacgcccacccgcacagactgtgccttgtgcgcccaggctgtgcgttacccactcaaataccgtacggttgtaataatctaaaccacgaactaaacgctcattaacggtatatgggatgctggccttatctaaaagttcacacaacccggcaaaatgttgttttgactcttcatccagataatcagacagttttggcgcatcatcaagcaactgctgaacatcagggtttttggaatctaacacccgcaacggattgctgtacatacggcgcttacaatcttcgtccaatacctcaacatgttgctccaggaacgccaccagcgcttctcgatagtcagcacgggcagccaacgaaccaatagagttcagctccaacttcacatgttcaaagatacctaatgcacgccaccagcgggctgtcagtaaaatcagctcggcatcaatatctggccctggcagaccaaagacttcggcccccaactgatggaactgacgataacgacctttttgcggacgttcatagcggaacatcggaccgatgtaccacagacgctgttcctgattgtacagcagaccatgttcaatacccgcgcgcacacagcctgcagtcccttccgggcgcagtgtcagactttcgccattgcgatcatcaaaggtgtacatctctttttcaaccacatcggtcacttcaccgatagcgcgtttgaataacggggtctgctctacaatcggcatacggatttcactgtaaccgtaaccgcttagcacttgcttcaagatgctttcgatacgctgccatattgccgtatcggctggcaggtaatcgttcataccacggatggcttgaatgttctttgccacgtcagttctctatagttttagtgcaagaaataaagccgattatagaggcttgccgcccgcatattcaatggggacggctcgttaactctattggcgcaatataaaactctattagcacaatataaaacactatcggcacaatataaaacacggtcacagcataactgtctgtttgattctggccgacaacaaggattgccgatagagcctatttattatcatccaattggttgataacaatccggttattcgcatcaagaattgatgctttggcacgaatttttgcttccaattggtcaatcatggctttgttatcaaagcgctctttttgacgcaccccgtcttcgtaaaaaccactgtggttacgcgcaccagtgacaccaattgtcgacaccaacgcttctcccggaccattaaccacacaaccgatgatagaaacatccataggtgtaatcaggtcttccagccgttgttccaaggcattcaccgtcccaataacatcaaactcttgacgagaacaggttgggcaagcgatgaaattaatcccacgcgcacgaatacgcagtgatttaaggatatcgaagcctactttcacttcttctactggatctgcggccaaagagatccgcaaagtatcgccaatcccttccgataacaacaaacctaatccaatcgcagatttaaccgaaccactgcgcgcaccacccgcttcagtgatccccaaatgcagaggattattaatttgtttcgctagcaaacgataggaattgacggccaggaagacatcggaggctttaacactgactttaaactgatcgaaattgagacgatcaaggatatcgacatgacgcatcgcggattcaagcagggcttctggtgtaggttcaccatatttctcctgaatatctttttccagcgagccgccattgataccaatacgaatagggatattgtaatcacgtgcacaggcaacaacttcacgaatacgtgattcattaccaatattaccggggttgatccgcaaacaatcgacaccatactcagccactttcaaggcgattcggtaatcaaaatgaatgtctgcgactagcggaacagtagactgctgtttgatcaacttaaaggcttcagctgcatccattgtcggtatcgagacccgcacgatatccacaccaacacgttccaatgctttaatttgggcaacagtggcatccacatccgtggttttggtattggtcattgattgcacagcaatcggtgcgccatcaccaataggcactttaccgacgtaaatccgggtcgatttacgccgaataataggggatccgttatgcattacatactctcctttacggtcgtgtagttcttacaacatgatatttgtcaaaaccatcatagtgtttaccaaaactacaagggtgcttgtcaaaaccatcattctactctacaccgacagtcaggcgggctacgcgattagccttaataaacttacttaaatctaccgggttaccctgatacgaaatcgtcagagcacctggtgcgccgatagtcagcttatagggcgctttacccgccaggttaaggacagcgccccctttttgaataccactaaacagcgtcttgcccgttgcatcaacaacctgcaaccaacaatctgctgtaaaattcatcaccaacgcccccacagatgacgtgctaccacttaccccagcgtctgctgtaggtaatggcgatggccctgtggacagaccaggttgcggtacctgacttggggaaacggccgctgacgcagccccctcctgatgcattgtggtatttgtattcgccgtatcgacaggttcggtactatttgtttttggaactaaagttgtttttggaactgaacttgttgttggaactgaactggttgtagctgaactggttgtagctgaattagttactgccgaagttgaatgatttgtcagtggtaccggctgaccattggctaccggtgccggggcatccgttggcgcaatagcatcgctgttatcatcagttagcggcactggttgcccgccattttgtgacagttgggcagaagattgatcaaccatattggcaatctctgcttgctgtgcctgatgattttgccaccaccatgctccggtcagacctaacacaaccaacacaataagccaggtgaaactcatcaaccagccatcacgttttttgtgttttttacccaatgaaaaactttgcattggggcaactttcgccgctctgactggcgcttgtttctccaaaataggcaataactcatcttcaggaagatgaaccagcttggcgtaagaacgaatgtagccacggtggaatgtcgaggcgagattagcttgcgcgttatcctcctcaatatcacggattgtggatactttcagacacagacgttctgcaacagtctgctgggttagccctaatgattcgcgggcttgacgcaggcgcacacctggcgtctctgtaacagtttgatcttgggaggcttcagtattcattagctagaaaatgctggtactgtttggattgtggaaaacttcgcgcaagctgcttgccatagcgttgtacactatcttgacggcctgccagcgcggcgaaacgaatttgtaaccataaactctcagcactggctggaagcgtatgttggtaaacatccagtaatagttgcgcttgtgcgcgattaccttccccaaaatacctttgggcttccgcaagcaaaggctcgcctttatccggatcatacttcaacgcccggctcaacaagacccgagcttgtttatcctgattagcccgtaaaaagcaataacctgcgttttccagactatcagcaacctgaccgtaatcaggtagcaatgccgcagcactaaactgttgttgcgccgatacatactgccctaaactacacagaaacgcaccgtaattattcagtacagtgccatttcccggagccagtttcattgcttgttgataacgctgctctgcggcactgttttcaccgatacgttgcgcataaaatgccatccctaattgagtgcgataatcctgtggatccgcctctaccgctttttcaaggttcttccgtgcggcagtaagatcgccttgtgccaaatacgctaaacccagttgtaagcgtgtctgcccagcaactgcctgactcgtgttctccggtggggtaccggagcaccctgtcaatacacttacgaccaggcaaactctccacagttttgtcagcttcatgctttctcaattgtccttatatatgcagataagtaccaaattctggcgctcatggtattctcatcacgggtttttagccacctttacgcgatgagacttcaacaaattataagttaaataacaattagttatctggtgaatcaatcttatgaatcagactgtcttaatcgcaataggttcacccgccattttctttttcaaggtgcgtttagtacggtcgataacctcaccggccaattggccacatgcggcatcaatgtcatcgccacgggtcttacgcacgatagtggtaaagccgtattccatcaacaccttagaaaagcgatctacccggctgtttgagctacggccataaggtgcaccagggaacgggttccatgggatcaaattgatcttgcagggcgtatctttcaaacactcagctaactgatgggcttgctcagtgctgtcattgatatgatccagcataacgtactcaacggtaacccgcccgccgttggctttggatttatccaaataacggcgcactgcagccaggaacgtttcaatattatatttacggttgatagggacgatttcatcgcgaatatcatcggtaggcgcatgtaacgagatagccaacgcaacgtcaatcatatcgcccagtttatccaacgccggaaccaccccagaggtggacagcgtcacacggcgtttggataaaccaaaaccgaagtcgtccatcatgatatccatcgctggcaccacattattcagattcagtagtggttcccccatccccatcatgaccacgttggtaatgggccgggtaccggttgatttcaatgaaccaataatttttgccgcacgccatacctgaccgataatttcagatacgcgaagattacggttaaagccctgctgtgcggtcgaacagaatttacattccaatgcacaaccgacttgggatgacacacacagcgttgcgcggtctgcttcagggatatataccgtttcaacttgttgatcgccgactttaattgcccatttaatggtgccatcgacagagcgttgctcttctgcaacttccggcgcacggatctctgccacccgctgcaatttcgcccgcagccctttattaatgtcggtcatttgctcaaaatcgtcgtagcaatagtgatacatccacttcatgacctgatctgcccggaaaggtttttctcccatttcggcaaaaaactcgcgcatttgctgacgatttaaatcgagcagattgattttgctggtagcaggtgcggtggtctgaacggtattgtcagacagaggtgcggcatcaattggcgttgatgcagttaataattgttcagacatgagttgtcgtggcctcgttgttacactttacggcgctgcgctttaaaccgggtacggcttccgaaacggcgataaataatagaatgtataaataatagaacgccccagcagagctgtctctactggggcgtggcattgtacaaattttaaagcacggattccatgaatggaaacgggtctgggcaactttattgtttcagttgattaaatccccccactttcctgcattgaatcaacccactagtcgcttaaattaacgcattagctacggggaaaaatttcatctgccgcaaagaaatacgcgatttcgcgttgagcagattcaacagcatcagagccatgtaccgcattcgcggtgaagctgtcggcaaaatcagcacgtagcgtaccggccagcgcattatctgggttagtcgcccccataatatcgcgatggcgctgtactgcattttcgccttccagaacctgaacaataatggggccagaggtcataaattcaaccaaaccatcaaagaacgggcggcctttatgttcagcgtaaaaaccttcggcctgttctttggtcaggtgcaacatctttgcggcgatgattttgaaaccagcactttcaaaacgcgcataaatggcaccgatgttgttattggcaacagcgtttggtttgataatcgagaaagtacgttctaaagccataataacctctattggatttctaatattaaccggactcggaacctgctctgataagcgtatttacttggctggcagcccgttcctttacactaataatgatgccgctttacgtatgccgaataatcagtggccgcagattataagtgcgcttgtagcaattgcatacggggatcgcaacatttcattaaaaaaaaagtatcttaaacgttcatttttatacacatctcacattttgtgtaaaaacctaaccacacctaatgtcactgaggaagcgcacataataatatttaatttatctttttttcaattagttagtgctaggtcctcttagagctcttcaataaatctaaagcccacttttttcttcacaatcgcggatggctgactgatcacagaagagaccaaggatattttccctttgcgtttaaagtggtcagccaatgctcgggtcgccgccgtacccgcgcctctgacggccccttccgcattaggtgtcagtacataatctgggttggttaatgacccggcaacccccacataattagtattgatatcgactgccatggtgaggctaataacctcgccctccaaacggactacgacgtaaacaaaatcatcacggctagtccttaaccaactggttgcaacttcgctagtcagtcgtgaagcctctaacaacggctcaatttcattccgagccaaggcactttctggaggaatttcagaggattgaaaaagtaattcttgttgacgatagctatgctgccacgcttcgataatcggcaaaagcacttgccggctcgcattagtctcttcgggaaccccgctaatcacttcaatatcaaaatgcagatctgggcgttctacccaacggccatcctgacgaatcctgggtaccgtctcgataaaatggtaatctaccagtgccagttcataacgccctaagggtagcgtctgcgcgctttgtggcggtatcacttcctcttcagtatggcgtaaataattaacataacttagctgggaaaaatcgaatgccgttttgagatgaatgatatctgcaacctctgtcgcttcagccacatgggcctgaactgactcgactaaacgtgatgcagtctccacatcggccacagcagaaccaatctccccttcgcgaacaatattttcgattactcgcccaaaatttttgctattccaatactcaatgctggcaccaaacaacaaggtaaaatcggttaaaatactcaaagtccaatcgatacaccctggcgcaagatcacgtcggctacgcagatgaggcaggattttctctcgcattgaggctttgcacgcgagtgccgttgccggtacggttaatgcgtgttcgcccatattggtcgtaatataggttaacgtccctttaacatcagacataaaattaattaatgcagattcgtcatctaatgtttcattgctattttttttaggcaagggtaaagaggaaccaaatatttgcaatattttatctgccgggctaccaaaaaaatcggcagcattatggacaaacttatctgcctgattacaatgcccctgaacaatatagttataaatactcagtatgggtattgtccaacaagtcgctagacccagagtactacgttcagcccggttatgctccttaccaacggttaataccattttatcgataactattgggctatttgcatctatattattaatatcaaaaataacatttgagttaacatcatcaaataatgttccaatcaaaggagaagaataaacaatttcattatttaatgattcaacaaattgaatttgaaaaaaaccaccattaaaacgcaataaaaatgacaaattactgcttttgttatctaaattaaacaaaaaaccctcaccatattttttattaccatcaaagaaaaataatttataatctttaacttttataagaccctcatcgaaaaattttattgaataatcatcggtgtcagacaactgaaagtcgactaatatatccctgtattttattcgtggatcaagccaataggatccaaaacttttttgtattttaaatttaattgatttttttatagaacagaaacgatcacaaatgaaatcctcatcttgagaaacacgcatactactgattttattattcattcttataatcaataaatcatcagatgtgtaatcctctgtcaaaacaaagtgtttaccattatagttatcgtcctcgtagactgtagtttgcattcctggagggatttttattgaatatacgtcatcattcaatggatttaccaaatgagattgtttcctttcaggatagctaccgctatacaagtcaaattgctcatcaccagataagcacaacgagtcacctgtaaagttactttcgccataaaaacaaactgccttttttattttaaatgcacttatattatcatttaaatatatcaaatccttatctgaaaccaaatccacatcggcttcaaaagaccgagaagcgcccaaaaaatcgacatcttcatagacggtgacaactaaaccgtggggaatggaaattgaggatatgcgatcattccatttatccggaatactggcaactgagttcccttgagccgcgcagagagactcaccattatagtcatcatccatataaaaacagactttgggttcatttgcataggcatcaaaaattaataaagagaacattaacgttagcatatggttacgattatatctcataatatatataccttttaaactattattaataatccattattttaaaaataagagattgttatttcctgacctaaaaattttatattagaataaataatttattgataattttttttattacaaataaatttattatgagaaacacatttaaaatacaaacacgaatacattgagttgcttattttttatagcctgaataattcaagttacagcaaggcggtaagcgagagacaagtggtcgaaagcacatttgaacagcatttactctgctcacagagacaaggcgagatccatggatcggccgagtcacgaagaaagccaacgacccgaattatttttggtataaacgctataaaacccacacaaaaaatccattactcaaaaaatcaaaaaaaactaaatatcatcaaaaacctgccagggaaattttgacaataaaaaaataacaaaaaaatatcatattatcattttaataattttttaaataaaacaccgaataatattaaataatcgttaaaaatcaataaaataaaacaacaaaaagatattaaaaataaattaaaccactctaataatatatgtattaattttttatattttaataattaggttttgtttttttgtgccggtatatttttcaacggaattaccttgtcaccattattttaaatgcgcctcctttcttttgaataacagtaaataggaaacacagaatatgaaaaacagtaatactcttaatacgcgtctgctaccactgtctattttaatttcatcgttggtttctggcggggctatggctgtgccagtagtcatcgacggcggcaacaatggtttggttgataacatctctaccccagtagctgatggtggcgctgttgctgttgaaccagctgttgaacaaccgggcctgcttgataagatcaaagatctgctggggttgggtgaaattactgaagaccaagccaaggcattaacagaaaacgttaaggctaaagctgaaaaagtggacgcacaggctgcggcgaagttggcacttgaatcagcccaagcagaggcccaaaaagcagcagaagatgctttatatctaaaaaccgaaaatgtttcatatcaggcattcgctcaaactgaagaaaagattaaaaaagaagctgatgaagcaaaaaaaaagcaagacaagtctaaagaagacgccattaaggccgtcattgttaataacgctccattagttcctggtgctgatgatattgctgagcaagtcaccaaagccgtgaccgatacaaaaaaagtacaggaagaaaaagcagttgaactagatgaaaaaacaactaaagcgacagaagccctagaagcgaaagaagcgaatacaaaggcgcttgaagaaatcaaagggcggctcggtactgtcacaaaagatttagaaacagcgacaaataccgataagccagcgctagcggagttagtcgtagaggctaaagcagctcaagccgacgacgaaaagaaacctttgaccgcgattgccatagctaaagcggctgataagaagacagaagctgagcttaacaacaacacagataccgacgagggcagagcaaaaaaagccgaagcagttaagaatagaaaagaatatgagcgattagctgcagaatatgaggagaaaatcgccgaggccgaacaaaaagttaaggacattgaggctaagatacaagagttaacaaaaaatcaaggttttatcaaaaaagaacaaagtaccgaagatgccaaaacagctgatttagattctacgctcaaaaaggctaacagcgctaaagtcgcagcacagggtgaattcgacaaggcagagacagcagctaaattagctgaaacagcagcaaaggctatcgaagcagcaaaactcaccgataaggcagttgaggatgcaacagcagctcataaagaagccgcagacaaagcggaacaaactaaagcagccgttgaagcggctgaaaaagttaaaacagaagctgataaactcgtagtcactaacactggcctattgaatgatgctgaccaagcacttgagcagttaattgccgaccaaaataacgtctctccttcaactgatctgccgaccattgatgtgactattgagcctaccaagacacaagatgtgattgagggcaccagcgccattgccacccaagtggctggtggcacacaaaatgttgccaagggcggtaaagcgattgatagcgttattaccaaagacggtattgtaaaccttgctgctggtgccaatgccaaagggaccgaggttactaaaggtaccctgaacaacaacggcggggttgataccgatactgttgtcagtactgaaggtaaattggttctgacaggtggtagcgaaacggccatcgcaacctcaaccggtgccaaggttgctgcaggtggcgtagtgaccgcaggtgaccattccgttatcgaaaaaatgatcagtagcggtgacgtgaccgccagcggcaataataccatcgtgcgtgatacgaccattaatgacggtaaattaagcctggcaggcaccgcaacggccaataacaccacgttcaacggcggtattttcagcgttgaaggtgataccactgccaccaagacgaccatgactggcggtaaatttgctgttacaggcaatgccaagatcgaagagacggtagtcagcgcgggtgacgtcttgctggctgataacgccaccgcgagtaacaccaccctgactggcggcaccttcaccgctgcaggtgatgccgcggtcaccgccacgaatatgcgtgacggtcaattggcggttaaaggcaatgccacaatcaaagacaccaaactcagcgccagtgacttctcgctggctgacaacgccaccgcgaacaacaccaccctgactggcggtacttttgccgctgcaggcgataccgctgtgagcgcaactaacatgactggcggcaccttcaccgttgcagacaatgccgcggtcaccgccactaacctgcgtgacggccaatttgcggtgacaggcaatgccacaatcaaagacaccgtactcaacgcaagtgacttctcgctggctgacaaagccaccgcgaacaacaccaccctgactgacggtaccttcaccgttgcaggtgatgccgcggtcaccgcgacgaacatgagtggcggtaaatttgcggttaaaggcaaagccaagatcaaagacacccaactcagtgtaggtaatttcactctggctgaaaatgccacagcgaatgacaccacactgaatggcggtaaatttgacgtctcgaacgaggctacagcgactaacaccaccattaataacggcctgtttacgctgaaagatggcgctcacgcggacagcaccacagtcaagagcggcaccttcgtcatggccgatcaatctacggccaacggcatccaactggtagacagcgccttcacactcgcaagcggtgctaaagcctccggtatcaccacgttaactggcggtcaggcacaggtagccggttcactggaaagcttgagccttaccggtggccgcgcagactttgccaacaacgccaaagcctctggcctgcttgatatcagcgctgatagccagatcataatgaaccgcggtgcagataccgcacaagcgaacctgaacctggctggccgccttgaattgctcgccagtgatgttgctcaggcagtggctcagccagctgcccgtgcggccatggagttatcaaatgcgcgtgcggtaatgccagcccctgcaatgccagtccctgccgccgcaccggttgcacacttcgccctcaacgatgtggttatgaccgggggcactgtcgatatgagcaacgcgaaaaatgctcaactgaccatggcttcactgaatggtacagggaactttaacctcggttctgtcatgcaaagcgattcggtcgcgccattaaatgtatccggtgacgcgaacggtgacttcatcattgcaatgaatagcagcggtcaagcaccaactaacctgaatgtggtaaataccaacggtggtgatgcacgctttgccttagccaatggcccgattgctttaggtaactacatgaccaacctggctaaagatgccaacggtaactttgtcctgaccgcagataaatcggctatgacaccaggcactgccggtattctggccgtggctaacaccacaccggttatctttaacgctgagttgagttctattcaacagcgtttggataagcaaagcaccgaaaccaaccaaagcggcatgtggggcagctacctgaacaacaactttgcagtgaaaggccgcgccgctaacttcgatcagaagttgaacgggatgacattgggtggcgataaagccactgcactggcagacggcgtgttgagcgttggtggtttcgccagctacagcagctctgatatcaaaacggattatcaaagcaaaggtaaagtggatagccattcattcggtgcctacgcacaatacctggctaacagcggttactacatgaacgcggtagtgaagaataaccagttcagccaagacgttaacatcacctcaattaacggcagcgccagcggtgtgtctaacttctcgggcatgggtatcgcactgaaagccggtaagcacttcaacttcaatgaggcttacgtctcgccatacgttgcaatgagcgcctttagctcgggtaagagcaacatctccttgtctaacggcatggaagcacagagcagcagcacccgctctacgatgggcacccttggggtgaatgcaggttaccgcttcgtgatgaacaacggcgcagaactcaagccatacgctatcttctcggtggatcatgagttcgcgaaaaacaaccaagtgacagtgaatcaggaagtgtttgacaataacttgagcgggacgcgtgtgaacaccggtgccggcatgaacgtcaacatcacccctaacctgtctgtcggttctgaagtgaagttgtccagcggtaaagatatcaaaacaccagtgaccatcaatctgaacgtgggttacagcttctaagtcagttgttgatacgaatttatcgtcacgatgataattgactgataaagggttattagctgataaagggttattgactgataaaaaccgcagggggctgcaattggctccctgctttttacctgattgattgtcattttatttgccagcccaaaggcaaataaaaaagcaatatttatctaggaaatattctctattgagccaagaaaaaatcaaaaaaagcagaatgccgtaaagataaatctcatttaaaaaatttttaatattttattaatagtggcttattgctttagccgttagttgtcacctaacttcactttcttaaacaaaaggcaaataaaacagaccaatatgaaaataaactaccccccaaaaacacccgtcacaatgaaataaattaatgccttattgaaaataatatcaatccgagttgattacattttcagtctatagccaatacttttttatccattatattagcggccataaattgtcgttagcgacatttttcactcttagtttactcatctgatcatctgtattcaggaacatcgactatgaaatctcgctctaacttaaacacgcgtttattgccgttatctattttaatctcctcattgatacctggtgccgtactggcagcaccttctgtcgcaataccaccgccggttcaagacctcatcaaccaagtacaatcttatgccaatgcgcacgtgatcagcccagagcaagcggaaacactgattaagcgcttaaccgttactcccgaaaaactcaaagaagaagaagcgcgggtgaaacaagaactggcagcggtagaaaaaaaacaaaaagaagcaaatacagaaattatcaccaccagtcttgaaaaagatcagtttaataaagcgcttaacaacacacaaaaggctaaattggcggctgaaactgtattcattaacgctaacagtaagcaaaacgaggcgattaaagcagtcaataaaaactggagcctagcggatgaaaatatcagtaaaaaactttctgtaatagttaatggcgagagcaagacacaggccattttagcagaaaaaataaaactgactgaaacggctgacatcaatcaacaagaacaaataatcaaagctcaacaactggatgcagaaattcagcagattaaatctgcccttgctgatgcggagagtaatggaacaacaggcacccttgtactacgacaaaaactggcgcaggccaaagaaaagctagagatagctaaaaatgaccctaaatctaaactcttcgacgctaaagcggcacatgacagaaccagtaaaaaccttgagggcccagaaggtttagcgaaaagagcagcgatacaaaataaaaaagtgtatgaacaggaacttaaagttcttcaagaccccatagacgtggcacaaaaacaattcactgccgctcaagacaacacgtttgcattaatggatgagcagatagctcttgctaaacaaaaaatagacagcactgcactaactaacagcctacaagaagtgtttaaacaagctaaaaatgcgcaactgcaagcggaacaagccgcacaacaagcgaaagacgctacaacagcgcaacaagcgatggcagaggccgcagcggcagagaagtcacttcaggaagtagaacaaaaactcgcggtcattgccgccattgcacaagaggccgaagttaaatttacagccgcacaattggctaaagcggatgctgagttacagttagccgataaaatggaacaactgacaaacattagtcagaaccttgcggcactgaatgacgccctgaatgacctcgatcccaaggtgaacagccaacagaccctcgccaaaggcgaagcgcaacctgttgctgatggcgagctagccatggcaaccaaggtggcgggcggtgagcagaatgtcaccaccggcggtgctgtgttagccagcgtggtcaccgaggacggcgtagttaacctgagcgacaatgcattcgcgcacgatacccaactgatcaacggtacgctgaataatacccgcgcccatgatgtgaatactcaggtcggcgcacaaggcaaattattgatcaacggcacccaggaagcggctgccacctcggaaggggcaacggtggccgcaggcggcagcgtcactgctggcacgaatgccctggtcaccaagatggtcagcgccggtgcggtaacaggtaacgacggcgctctgtttactgaaacgacccttaatgacgggcaatttagcctcaacaacggcgcaatcgctcaaaacaccaaggtcaatggcgggcaatttaacgttaatgaaggcgcgaccgccgagggtgtgacggtaaaaggcggtgaattcaacctgcgagcgcgcgctcaggcgatgaaattaaccattgagttcggtgaagcacagatcgccggcacgctgaccgatgtgacactgcgcggcggtaataccaccctggctagcagtgccgacgtggcgggcaccattcactcaatatcagggagtgcgcttaaggtttatcaaggcgcacataccgcacaagcggatctcaatctggcggggcgagtggtgttattcgccgacgacgttgccccaatggcagcactgccctcacgggcggtacgtgctgccgataaccgtttatccgcgccatttacctttagaagagtcaatatgagcggcggcacactggatttacgcaatgtgaaagatgcacagttagtgatggactcgctggcaggcaacggcaccttcaaactgggctcgatgctgcaacaagacgcctcggcactggtgaatgtcacgggtaacgcggatggcgattttaccctccagatagacggtagcggtatcgatccgaccaaccttaatgtcgttagtaccggcggcggtgacgcacgttttaccctaaccgatggcccgataggccttggcaaccgcgtgtataacctggttaaagatgcgagtggcaaggtcacgctggtggctaatgaatcaaccgtgacaccgggtacggccagtattttagcggtggctaacaccacaccggttatctttaatgcggaattaagctctgttcaacagcgtttggataagcaaagcaccgaagccaatgaaagcggcatctggggtacctacctgcacaataactttgcagtaaaaggccgcgccgctaacttcgaccaaacgttaaacggcataacgttggggggcgataaagccactgccctggcagacggcgtattgagtgtgggggggttcgccagcgcgagtacatcaagtattaagaccgactatcaaagcaaggggaatgtcgatagccactcatttggggcctacgcgcaatatcttgccaacaacggttactatgtgaatggcgtggtgaaagccaataaattcaatcaagatattcatgttaccagcgccgataacagcgccagcggcaacactaatttctcgggtatgggggtggcagtgaaagccggtaagcatatcaaccataatcatctgtatgtttcgccatacgtggcgatgagcgcctttagctcgggtaaaagcgcggtcaaactgtctaacggcatggcggcgcaaagcagcagcacccgctcgatgataggcacccttggggtgaatgcgggttaccgcttcgtgctgaaaaatggcgtagaaatgaagccttatgtcagtgcctcggttgatcacgaatttgctgctaataataaattcagagtgaaccaggagatgttcgataacaacctgaacggcacgcgtgtgaacaccggtgcaggcctgaacgtcaacatcacccctaacctgtctgtcggttctgaagtgaagttgtccagcggaaaaaacatcaaaacgccagtgaccgttaatctgaacgtgggttatcgcttctaagtcagttgttgataggtcagttgttgataggtcagcagttgataggtcaatcattaataagtcaattgttgaaacgaacgtttatctctttatcgtcacaatgatgattgactgataaagggttattagctgataaaaaccgcaggggctgtaattggctccctgctttttacctgattaattgtcattttatttgccagcccaaaggcaaataaaaaagcaatatttatctaggaaatattctctattgagccaagaaaaaatcaaaaaaagcagaataccgtaaagataaatctcatttaaaatatttttaatattttattaatagtggtttattgctttagccgttggttgacacagaatttcaccacctaaaaaaagacaaataaaacaaaatgatccaaaaaaaaacaaagtcacttaaaaaacaacagtcagaataaaaaatcaatttttattgaaattaatatcaatccgagttgattacattttcagcatatagccaatacttttttatccattatattagcggccataaattgtcgttagcgacctttttcactcttagtttactcatctgatcatctgtattcaggaatacctacaatgaaatctcgtcatcatttaaacacgcgtttattgccgttatctattttaatctccgcattgatacctgctgccgtactggcagcaccttctgtcgcaataccaccgccggttcaagacctcatcaaccaagtacaatcttatgccaatgcgcacgtgatcagcccagagcaagcggaaacactgattaagcgcttaaccgttactcccgaaaaactcaaagaagaagaagcacgggtgaaacaagaactggcagcggtagaaaaaaaacaaaaagaagcaaatacagaaattatcaccaccagtattgaaaaagatcagtttaataaagcgcttaacaacaaacaaaaagctaaattggtcgccgaagctgtattaattaacactaataataggcaaaacgaggcgattaaagcagtcaatgaaaattggagcctatcaactgataacctcagcacgaagcttataacaatggttaatcgtgagagcgagatacagaccgctttagacgaaagaacaaaacggcttgaaaccgcgaacgcccaacagcaagaacaggagaaaaaattgcaacagttgggtgacgatatccaagaaaaacagtccaagattgctgatgcgaccactaataaaacatcaggcaccattgcactgcaaaacaaactgtctcaggcccaaaaaaagctaacgaccgatcaaaaaaatcctaaatctgcactaaaactggctgaaaccgaacataacaaaacccaaaaagaccttaatagccccatcaaaaaaactcagagccaagccatacaaaatgaaaatacctataaagcggcacttaaagctcttcaagaccctatagacgaggcagaaaaacaattaactgccgcccacaaaagaattgacacattaggaaatgaacaggcggatctttatgaacagcaatcagccagctatgcgctaatcgataacctaaaaaacgaggttaaacaagctaaaaaagcccaacagcaagcggaaaaagccgtaaaaataattcaaaacgctaaattagcgcaacaagcgatggcagagaccacagcggcggagaagttacttcaggaagtagaacaaaaaatcaccaccattgccgttatcgcacaggaagctgaggcgaaattaactgctgcccaacgggctaaagcggatgctgagttacagttagccgataaaatggaacaactggcaaacattaacctagaccttacggcactgaataacctcgatcccaaggtgatcagccaacagaccctcgccaaaggcgaagcgcaacctgttgctgatggcgaactggccatggcaatcaaggtggcgggcggtgagcagaatgtcaccaccggcggtgtggtgttagccagcgtggtcaccgaggacggcgtggttaacctgagcgacaatgcactggcgcacgatagccaactgatcaacggtacgctgaataatacccgcgcccatgatgtgaatactcaggtcggcgcacaaggcaaattactgatcaacggcacccaggaagcggctgccacctcggaaggggcaacggtggccgcaggcggcagcgtcactgctggcacgaatgccctggtcaccaagatggtcagcgccggtacagtaacaggtaacgacggcgctctgtttactgaaacgacccttaatgacgggcaatttagcctcaacaacggcgcaatcgctaaaaataccaaggtcaatggtgggcaatttaacgttaatgaaggcgcgaccgctaaagataccgaggtcagcgccggtgcggtaacaggtaacgacggcgctctgtttactgaaacgacccttaatgacgggcaatttagcctcaacaacggcgcaatcgctcaaaacaccaaggtcaatggtgggcaatttaacgttaatgaaggcgcgatcgccgagggtgtgacggtaaaaggcggtgaattcaacctgcgagcgcgcgctcaggcgatgaaattaaccattgagcacggtgaagcacagatcgccggcacgctgaccgatgtgacactgcgcggcggtaataccaccctggctagcactgccgacgtggcgggcaccattcactcaatatcagggagtgcgcttaaggtttatcaaggcgcacataccgcacaagcggatctcaatctggcggggcgagtggtgttattcgccgacgacgttgccccaatggcagcactgccctcacgggcggtacgtgctgccgataaccgtttatccgcgccatttacctttagaagagtcaatatgagcggtggcacactggatttacgcaatgtgaaaaatgcacagttagtgatggactcactggcaggcaacggcaccttcaaactgggctcgatgttgcaacaagacacctcggcaccggtgaatgtcacgggtaacgcggatggcgattttaccctccagatagacggtagcggcatcgatccgaccaaccttaatgtcattagtaccggcggcggtgacgcacgttttaccctaaccgatggcccgataggccttggcaaccgcgtgtataacctggttaaagatgcgagtggcaaggtcacgctggtggctaatgaatcaaccgtgacaccgggtacggccagtattttagcggtggctaacaccacaccggttatctttaacgcggaattaagctctgttcaacagcgtttggataaacaaagcaccgaagccaatgaaagcggcatctggggtacctacctgcacaataactttgcagtaaaaggccgcgccgctaacttcgaccaaacgttaaacggcataacgttggggggcgataaagccactgccctgacagacggcgtattgagtgtggggggggtcgccagcgcgagtacatcaagtattaagaccgactatcaaagcaaggggaatgtcgatagccactcatttggggcctatgcacaataccttgccaacaacggtggctatgtgaatggcgtggtgaaagccaataaattcaatcaagatattcatgttaccagcgccgataacagcgccagcggcaacactaatttctcgggtatgggggtggcagtgaaagccggtaagcatatcaaccataatcatctgtatgtttcgccatacgtggcaatgagcgcctttagctcgggtaaaagcgcggtcaaactgtctaacggcatggtggcgcaaagcagcagcacccgctcgatgataggcacccttggggtgaatgcgggttaccgcttcgtgctgaaaaatggcgtagaaatgaagccttatgtcagcgcctcggttgatcacgaatttgctgccaataataaattcagagtgaaccaggagatgttcgataacaacctgaacggcacgcgtgtgaacaccggtgcaggcctgaacgtcaacatcacccctaacctgtctgttggttctgaagtgaagttgtccagcggaaaaaacatcaaaacgccagtgaccgttaatctgaacgtgggttatcgcttctaagtgaataaaatcattttttagagatgacggtgtggcagaaatggaagggagcctctattggctccctatccttttagatactaatcagtggttcgtcgaaggaataacatttctcaaccaactgccccatttgcgttgataaaacgcctgcgtatgggtggtgagatagtggctgacccctcgctctttttcactgaccaggcaaaaatctaccgggccgccgtctggggcgtgatcactggccacattaccggcctcttggatcaactgatctacttcattagcggtgccatccacttccaaaccaatcaacaggttgggtttttcatcaacacttttatcatgcatcagcgccagaaaagcccgccgcactggtttacgctgactaaataattggatcagtgcatccaccatcgcggagggatactcctcgggttggcccagtaaaatttggctctctttgtctaccaccatttcagcgggttgcaccaacccgccgttcttcaacagcatcgccacttcttccggccagaactctttgccatattcagattttgggttcaaaaacagatgtgcgccttgtgtcatttcaaataacacccgcaccggcatcgcgacgaaaggctgcttttcactgccgatggtctcgccatcagtttgttccaaggcctgctgcaagacctctaccgaggtgaaaaaaggaatgacagactcaccatcttgcttttcccaatgcaaaatattcaccccgttagcggtggtgaaactcatttcgccatcatcactgccctgctctgaatcccctaccagtaccaagaccgtggcatccaacaacacgcggaaaaacgccgtgcgatgaatagacgcggtggcggccagtttcagcaaagattccagatcctcgccatgttcgtcatgatggtggtgttcgtgacgctcgtcagcggcagagttgtcatcggcggtatggttatcatcagcagccgggctatcatcaatagcatgtttatcatcaatagatgggggcggaaaactcattttttactcccaaaacatcgagaagatgaacgaagggacgccaaatgcgcccctttgagtcttctcaattcaataagattactgttttgcttgcgctaacaataagttggcaacggtgcggacacccaagccagtcgctccggcagaccattgatcaacggcgcttttgcgatatgtcgccgagcaatcaatgtgtaaccagccctgctgataatttttcacaaaatgcgacaggaaagcggcggcggtgctggcccctgcgctgtaggccccaccggccacgttatttaactcagcaaagttagatggcaactggctgcgatggaattcagccagtggcagacgccagaaaagctcgtgctcactgtgcgcactgttgagtagcgcttgtgccagttcatcatcaaagctgaacagggcatggtaatcgttacccaaggcagttttggccgcgccggttaaggtggctgcgtcgataatcaacggcgcattttgctcggaggcatcgatcagaccatccgccaagaccaagcgcccttcagcatcggtattcatgatttcgaccgttttgccattacgatagcgaataatatcgcccagcttaaaggcattgccactgaccatgttatcggcacaacacagatacaacttcacgcgctctttcagcccacgtgcggctgccaacgccaatgcaccggtcaaggttgccgcaccgcccatatcggacttcatcgaatccataaaggcgctctgctttaagctatagccgccggaatcaaaggtaatgcctttccccaccagacaggccatgactggcgcatctgggttgccggttgggttgtagtccaacgccaacaataccggcgcacgatcagaaccacggcccacggtgtaaatcccggcatagttctgttcacggagatcttcgcctttggtaatacggtagctgaccgcatcacaggagaccgcacacagcaaatcaatcgcatttttcgccagttgttctggccctaaatcttccgcaggtgcgttgatggtatcgcgtacccaatcgatgatttgtaaacgctgttccagctctgttttttcattcgctggcagctctgcccacaccacgctgcgctgaccttttggcccacggaagccttgccaaaaggcccagctttgttccaggccccagccttcaccagccagtttgacttgtttaatgccctgaccgtcaattttgcgggctgcacgttggatcccccccagttgatcgtgactcgtcaagtggatagtcaccccttgatcattagtgctgatcagggctttctcaccccagcgggcatctgccgggttgtgagacagggatatttgcattatttctgttgtcatggcctacctcgtcattattatttttgctgtatacccgtcatgcttcaagccacaggggcgttagcggcgacgtcaataatttgggcataaaatatcagatacgcaataaaaaaggccgcttgcgcgacccagtcagtattcactcaaactcatctaaccagaccagtaagatcgcttccagtactttttcattcgatctttgcggatcgtcgtcaaaaccgtccagctcacaaatccattggtgcatatcggtaaaacggaccgttttgggatcggtatccgggaacctttcgtaaagggcttcggcgatttcgcgggtatcttgccacgttaaactcatatcaatcctttctacctattgcgataacgttagtgttctcgggcatggttaatggtatagcgtgggatctcaaccaccagatcttcatcggtcactctcgcctggcaactcaggcggctctctggctccagaccccaggctttatccagcatatcatcttccaactcgctgctttctggcagtgaatcgaacccttcgcgcaccacgcagtgacaggtggtacaagcgcaggatttttcgcaggcgtgctcaatatcaatcccatgacgtagagcaacgtctaatatggtctcaccttgtattgcttccagtactgcgccatccgggcaaaggtctttatggggcagaaatactattttgggcatgattaaacctcatccactgaatgacctgctaaagcacggcgaatggaagcgtccatccggcgtgcggcaaaatcttgcgtttgtgcatctaacgctttggtcgcagcttcgatggcttgtgggtcgctgccctgcatctgctgctgtaataacgcgaccgcttgggcgatcgcggcactttcttgctcactgagtaacgcggcgtcttctgccagtgcgccttgcaggctctctagcactctggcggcatcaacctgttgttccgccagtttacgggcggtgatatcactttgcgcattcgccatggaatctttaatcatattggcaatttcatcatcagacagcccataagatggcttcacctgaatcgatgcctcaacgcccgtcgatttctccatcgccgtcacacttaataagccgtcagcatccacctggaaagtgacacgaatatgtgcccctcccgcaggcaaaggaggcaagccacgcaacgtaaaacgggctaatgaacggcaatccttcaccaattcacgctcgccttgcagcacgtggatcatcatcgcactctgaccgtctttgaaggtggtgaactcctgcgctcgagccgccggaatggtggtattgcgggggatcactttctccaccaaaccgcccatcgtttccagccctaaggagagcgggatcacatcaagcagcaacatgtcactgtccggtttattgcccaccagaatatcagcctgaatagcggcaccaatggcgaccactttatcgggatcgatagaggtcaacggcgtgcggccaaagaattgccccacctgctctcgcaccaacgggactcgggtcgaaccaccgaccatcaccacttccaaaatttcatcagccgtgacgcccgcatctttcaaggcgcggcggcaagccatcagtgtgcgttttaccagcggagcaatgagcgactcaagctgctcacgagtaacctccccttgccagccagccacggaaactaccgcagtctcggcctcactcaaggcaattttggcggcaattgccgtatcaagtaactgccgttgaatgccgtggtcatcccgggtcgctaccccggcttgctcacgcaaccagtcagccaagaggtgatcaaaatcatcgccacccagcgccgagtcaccaccggttgccagcacttcaaatacgccacggcttaaacgcagaatggagatatcaaacgtcccgccccccagatcataaaccgcaatcaccccttcctgaccggaatccaggccataggcgatggctgccgcagtgggttcattcagtaaacgtaagacatgtagccccgccaaacgcgcagcgtcttttgtcccctgacgctgagcatcatcgaaatacgcaggaacggtaatgacaacgccatcgagctcgccggccaatgccgcttgcgcccgctgagccagtgttttgaggatctctgccgacacctgaaccggattcaccaacccacgcgccgtctggatcatcggtaaaccgttttcactcgcgtggaattggtaaggtaaattgggataacgctgtacgatatcagccagagagcggcccatcatgcgtttcactgaactgatggtattaaccgggtccaaggccgccagattgcgcgccttccaaccaacatcaataccctgtgggtgataatgaaccactgacggcagtaaatcccgctgtttttcatttattagctgttgacctgctattaactgttcaccagcgattaactgttcaccagcgattaactgttcatcggctaactgttcatcggccagcgtctgcgctttaccgctgcgcacggtcgccaccaatgaattggtggtacctaaatcgatccccgcagccagccgacgttggtgtggtgccgcggttaaacccggctcactaatttgtaataaggccatgttgagcttccatcaatcatgagtctatacccttcgtatttgaagctgcaggaggcttagctgcgcacatgactcggcccatccagtggcctctacgaggctgctgcaagccacgttcaaatcagttctcgaccgatttgtcatttgcttgctacctagctacaacatcaattactaagggaatataataattaatcacttgaattttatttgttttttattaatcaaatgagatatttgaatcaggcaaaatcgtcaaacaagcgctcttccaactgttcaacttgctgctgcaacttatccagaaagcgcaatttgcgtaccgtatccgctgcctgcacccatagctgcgcatccagttgctcaaccatttgctgcgtgcgcgttgttgtcatctgcgccaaacggcggctaaattcagccagtaaagtttcagcatcgggtttgcgctcaatggcatcaagctcctcacgtaattccaactgttccatcagaaacgcggtatcacgcatagtgtgttgttcgttgcctaaatcaaaaccctgcaaagatagcatatactcggcacgttttaacgggtgcttgagcgtttggtaagcatcattgatggttgcagcctgctgcattgaggccaaacgctcacgctcgggctgggtggcaaagcgatcggggtggaattgacgttgcaactcctggtaacgcgtggtgagttggttgccgtcaatcaaatagcgagccggcaacccgaataacgtaaaataatccatagcatgctctggaagttgttgtaatggctaagctgagatctgtttcgctcccttttggcaaaagagagcggaacagagcaacaaacatctggggcaggaaaaagcagcgatcaaacgttaaagctttcgccgcatccgcactcatttgagacgtttggattgttgaacttaaagccttcgttcagcccttctttgacgaaatccagctcggtaccgtcaagatagaccatgcttttaccgtcgatgatcactttcacacctttgtcttcaaaaacgatatcgtcatcgtttatttcgtcaacaaattcgagtacatatgccatgccggaacaacccgaagtccttacgcccaagcgtagacccaagcctttaccgcggtgatttaaaaaggcactgacccgctgtgcagcactgtcgctgattgatatcgacatacaacaacctcaactctgagaaccagctcatatccccgtcatctttcaaactacaggtgttggttgcgctcgttcacccaaatgacttacctgtgtaagctcatcgggatcctcttgtttgccgccttcctgcaacttgaaatcttttggatagactaagtgaaaaatgagctaattattaataacctatatatacctgtcgtccttcaagatgcacgagtgttagctgcatctcgaagtcacttggatataaaaatcacatatcacaattacttggcagtatgcttgcttttgtagtcggcgattgcggctttaatagcatcttctgccaaaattgagcagtgaatcttgactggcggtaactccagttcttcagcaatctgagtatttttgatggcttcagcctgctcgagagacttgcctttcatccattcagtgactaaagagctggaggcgatggcagaaccgcaaccataagtcttaaagcgggcgtcttcaataataccggcttcattcactttgatctgcaacttcatgacatcaccacaagcgggtgcgccaaccatgccactaccgatagtagggtcttgactgtcgaacgaccccacgttgcgtggattttcgtaatgatcgattactttttcgctgtaagccatgtgatttctcctgagtcttaaagtgtggaattaatgatgggaccattcaatgctgctgatatccacgccctgcttgaacatatcccacaatggggataaatcacgcagacgaccaatggatttatgtaccagcgcaatggcgtagtcgatctcttcttctgtggtgaaacgccccagagagaaacgaattgaactgtgagccagttcgtcgttcatccccaacgcacgcaacacgtaagaaggctccaaactcgcagaggtacaggctgaacctgatgagacagccaaatctttcagtgccatgatcaacgactcaccttcaacatagttgaagctgacgttcagaatgccaggagcgccattctctaatgagccgttcaggtaaacttcttcgatatctttgatgccgttccacaaacgcaaacgcagtgaacgcagacgtgcagcttcgctttccatctcttctttggcaatgcggtaagcttcacccatcccaacgatttggtgcacaggcaaggtgcctgaacgcataccgcgctcatgaccaccgccgtgctgctgtgcttcaatacgaatacggggtttacggcgaacaaacagtgcgccaatgcccatcgggccataaactttatgggcggagaaggacatcaaatcgactttcagtttactcagatcaacaggtaatttaccgacgctttgtgtagcatcaacgtggaaaatgatcccgcgactacgacacatttcgccgatttcagcgatatcctgtaccacaccgatctcattattcacatgcatgatagaaaccaaaatggtgtcttcacgcattgtcgcttcaagctgtttcagatcgataataccgttaggctgcggtgccagataagtcacttcgaagccttcacgctccagttggcgacagctatccaacaccgctttatgttcggttttacaagtgatgatgtgcttgcctttcttctgatagaaattagcagcacctttaatggcgaggttatcagactcggtcgcaccggaggtgaagacgatctcacgagggtctgcacccaccaatgcggcgacgtcattacgtgcaatatcaacagcttcttctgcctgccaaccaaacttatgcgaacgtgaggctgggttaccgaagataccgtccagagtgagatactgcatcattttttcagcgacacgcggatctactggcgtcgttgctgcataatccagatagatcggtgtctttacttttgattcggtcattgctcttatgctccgtacatcacttccaaaacgtaaaattccgcaaattctgcttatgcgcgcagattgacgttaatcgtctcttgcggtcggccattagccgtgcggcgcgtatcgttattctgacgatccgctacctctaggatatcttggttattaaccagttctgccaatgtaatattgttgaggaagctgctgatacgctcgctcaaatcacgccacagggtatgtgtcaggcagcgatttccgccctgacagccttctttaccctgacaacgggttgcatcaacggattcgtcaacggcagtgataaccgcgccaaccgcgattgctgatgcatctttgcccagcagataaccaccgcctgggccgcgtacgctggcgactaagccatttttacgtaggcgtgaaaaaagttgttccagataggataacgagatcccctgacgttccgaaatatctgccagaggaacgggcccgtcctgggaatgtaatgccacatcaagcatggcggttacggcatagcggcctttggatgtcagtctcatagctaaagttacctgttggtgaacacgaaacagaattttgacattcttgagtgttttagtcaactatttaacctagtaattcactcaactattatcaccatacttacgctcgatagtatcaattagaattaattataaccaattgatataagacattaatccttactcttacccgccgtatcaccggtaccgcgttgtggatatttatcctgcttttcgatggatgtcagcatcccacgtagaatattcagctcttgagcctcgggccgagcgcgggtaaagaggcgccttaatttgctcataatctggcccggatgggcctggcggataaagccactatgagacaaaacctgctccaaatgctgatagaaacgctccagatcatccaccaaaggataaggtgcctcttcctcttcttctacaggggcatttgcctgctgacgatcaaggtatgccacccgcacttcataagccaaaatttgcacggccatggctaaatttaaggagctatattcaggattggcggggatagccacatgataatggcatttttgcagctcgtcgttagtcaggccaacacgctcgcgaccaaacaccaaggcaaccggagcatgttcagcttcgcgcgcactgcgtacaccgcattcacgcggttccagcattggccaaggtaacgttctggaacgggcgctggtgccgaccaccaaactacaaccggcaagggcttcatctaacgtatcaacgatagtcgccttaccaataacatcactggcaccggctgacaaagcaatggcctgagaatctggttttaccaatggattaaccaaatatagattggttaatcccattgttttcatggctctggcggtcgagcccatgttgccggtgtgtgaagtttcaaccaagacaatacgaatgttgtgtagcatacaaactctgaggataacggataatcgccatatcttaacacagacataggcatttatcagatcccctgctatactgtgcgccgtttctcgttctttaacatcctagtggaagatacccatgcatccgatgctgactatcgccatacgcgctgcgcgtaaggccggtaacctgattgccaaaaattatgaaaccccggacgctgtcgaagcgagccagaaaggcagtaatgactttgttactaacgttgaccgcgatgcagagcatctgatcattgacgttatccgtaaatcttacccaaaacacactattattagtgaagaatgcggtgagttggtcggcgaagatgatgatgtacaatgggttattgatccactggatggcactaccaacttcatcaaacgcctccctcattttgcagtctctattgccgtgcgcattaaaggccggacagaagtcgccgtggtttacgatccaatgcgtaacgaactgttcaccgccagccgtggtcaaggcgcccagttaaatggttatcgtctgcgtggtaccaacgctaaagatttagatggcactattctggctaccggtttcccattcaaagtgaagcaacacgcccctgcttatattcgcgtcgtcggtaagctatttgagcagtgtgcagatttccgtcgcaccggttcagccgcattggatctggcttatgtcgcagcaggccgtgttgatggcttctttgagattgggttgaaaccgtgggatttcgcaggtggcgagctattggttcgtgagtctggtggtatcgtgactgactttgccggcggccataaccatttcagctctggcaatatcgtggccggtaatccacgtattgttaaatctatcgttcaagccatgagcaacgaaatcagtgatgcgttaaagcgttaattccacgcaaatagccgtttcagataaaaagccagtcagggttagccgactggctttttttattgggaacccctctgcggcgtcaaggtcgaagggtatcagcgaccaaatggacgaacagccccaaccatctccggctgactggacaaataaaacagaacccccgcgaacagcagaataattcccccggttaatgccagcgtggcccaggcaatctctccccaagcggcaggggcgcgtttacggcttaaatataccgccaagcgccgtgcataatggacgaacagtgccaacagcgagatagtcagcgacgtccctaaagccatcgccatcgccgacaaaatcccccaccagtaaacgccaatcaccttggaaaacagcaacaccataatcgcaccggagcaagggcgcatccccatcgccaatacaatcgtcaaacgggtgcgccaatcgccaccggcttgtagctctttatcactgggcagatgacggtgcccacagccgcagttgtcgctgtgcacatggttagccggtaatggctgaatctgctgaaaagtcattttctgtggttttaaggcgttaatttgtcgatagatccgctttaccgcccggaaacagagcaacatccccaacccaataaccaatagaaaactgcctttttctagccaaaaactgctttgatgcagataccgtgaagagagctgccataccccaagtaacaaagttaccagtagaatcgctacgctaccttgcaatattgaagcggcaaaagtcagtttcaggctgctttttaaccgcgccgggtgggttgccagatacgtcacaatcaccactttaccgtggcccggccctacagcatgtaacacgccataaatcaggctaaacaacatcagcacccaccccgcctgatgcggttcggctttaacttgctgcaacagttgggccatttgctgatgcacacttttttgccaggctactgttttaaacagcaattctggccaataaagccaggagacatacccagcgctagccaatatgagtaagaacaacaatagaggccataaattgatcagccaatgtcgctgtttgggccgtggaatcggagcaataactactgacattgaagcgtcacttgttgggcaaattgttttccaagttccatatcgtctcctggtgaatcacttttatccaatgacagcgcataagcctgtagcgatgcgtctgggttgggagtcatcaaagtgagtttgcagtttttttccatttcagccgatagactgagcgctttttgatccgcataggccatatcgacaaaataagtcgggtcataggttgagataataaaaggcttaccgactaatggctgcagctcagccaacggtaaaacgaatgagagtaccgcctgatgcccctgacgggataaatgatattctgttggcaaatttttatatttcaccggttggccatcacggtatatatcggtgaaatagtgctgccccagcacattagccatcacttctgcggccagtttcttccagatttcagagtcacttttggcattctctgcgtcatacaacaggtcagaagaggttatttcatccatggtccataccattttcattcccaccagcatctgtttttcattgatgaaagtggttttcatatcaataaaactgtgggggtgcgcttgagccaattggctataaatcattgcggccccggttaataacaaggttatcagccggctgactgtaataaaaccgttataatgtaacacatagcgcattattcaacccttggatattctgcaattactgtgatgtaagttgtaagtcgatgtaaaaaactactggcccggtaaaccgaatgaatctcttttgctatgcttaaatccgataaataacgatgattcatcaaagatatttatatgcgcctaaacacgccttttaagcctcggttatctgatgatcaaccgctatctggtcaacaacgccgctgccatatgttgctgatgttatttatgccagcacgcaaggtacagttagacaccattagccaatttaacggggtcgatcttgcgactacccggcaagatatagccgaggttgctagcgaaatccagcgtttctaccatttggaacttaatgccagtgccgacgattattatcagattaatgggagccgactcgataaacgactctgtttgatccattggctacgtcgtgggctgcgttattgtccacattttattgaacactatttttcccccgatttatatcaagcactggcgtggaataatggcctgctgtcgtcggctctgcgacgatcaactctacgacaatcaactttgcgacaatcaactttgcggcaatcaattctacggcaatcaactttgcgacaaatcgtttaccagtgtgagccccacctaaaccgccaactcagtgaaaaagatcgtcagtttttgcaactgtatttggcgtattgtgtctgggaaaaccaacagcacaccgtgccacaattatccatgacccaacagcaatggttagaacaaaaacctgcgcgggttgccgctgatcatttattcaatgcactcaaccggttattgatccctccgctgggtttaattgagcgcgatatgctgatcctgatgttgacgatgatcaaagcacaccactaccacagcacccaatcaccggaagatgcccgcctgatagcggctatcaagcaattaattcaccgttttaagcgactgtccggcatgcattttagttgtgatgactcgctggtcagccagctattcgcgcatctcgcccccgccattgagcgttgctattttaatattgggatcgaccattcactccccaaagatatcagtaagatgtatccccgtttgctccgtaccacacagcaggcgctgatcaagtttgagcaggagtaccagattcgcttttctattgaagaagtgattttgatcgccatcagcttcggtgcctggttaatacaggggaatgcattacaggagaagcagattttattattgacgcacgataacccaatattggaagcccaagtcgagcagcaaattcgtgaactgaccttactaccgctacatattaaatatttatctcatgatgtttatctgcaatcaggggcccccgcgggcactgcggtggtacttaccccctatgttttgcaatcaactgaatcagcgccgccgctgattcagatatcatttccgttaactgagccgcaaagtattcagttatgccgcatattggaactgccttagctggctaattcatttaggttcgcggccactcgtggccggataaacagcgccggaataacaatgagcgccataacccaaaagaccccactctgataattctcaaataagaagccggaaatcactgtcatcaccgcaataccgccgcccatcgctagcgccgagtagactgattgcaaacggatcacatccgccccactgcgggccgaaatgaaacgcatcgcggccagatggcagacagtaaacgaaccacaatgtaaaatttggataaaaatcaaccaaggcaattcagtcgttgaagccattaagctccagcggattatcccacttaccgctgagagcagtaataagctacgggctgtccatcgacggaaaaggatgtgactgaacgcaaataccagaatttcggccacaacccccagcgaccacaaatagccgatggttgcgggggaataaccggcatctttccagtaaatagaactgaaactgtagtaagccgcgtgggcaccctgtaataacgtcacacagagcaaaaagcgccaaacttgcggctcggataatagaaccttccatggcgttgcagcaacattgcgatgtttaacctcaccccgtggcatcacaccaggccgtaacaatgcccccagcaacatcgctgtcacaccaaacagcaggctgtagagaatagcgggatggccccaaacggataccaattttcccgtcagcgcagagccgataacaaacgccagcgacccccataaccggaccttgccgtaatccatggtgatctgtttttgccacgtcgcagccaaagcatcggtcaatggtaccagtgggccaaagaacaagttaaaacctgcgataaccaccatcaaccaagcccagccgttaccaaaccaaaaaccgaccgcaaacgctaacgtcagaagtgccaaaatacggattgcagtaaccagatgagaaggatcttttactctcggagcaataatgaggctgccaaggaagcgggagagtaaaccagcaccgagcaaaataccgatggtttccggggggataccttcaccttctaaccagagtccccaaaaaggcagaaaaataccataagaaaaaaaataggtgaaatagctgagcgatagccaacgtgttgattgcaataccatgattcctccggggtcagcccgtcactgtgacagaggcctcctccgctagcaactttaccgtctcaacactggattttttgtgacaaacttcacgttaaaaaatcgtctatgagccagaagcagcccggtattcattggtgacttgctcgaaataatgttgttgttcgaaatattgtgattgtttgaaacacggtgattgtttgaaacgcggtgattgtttgaaacacggtgattgtttgaaacgcggtgattgtttgaaacacggtgattgtttgaaacacggtgattgtttgaaacgcggtgaaggacggattcttttagcattggaataagctcgttttttagcctacccctattaatttaaagccccagctataaggccaggactttgtcagcaatctgaaaccaccattatggtgggttttcatggttaggaggacgttagaaccggtaacccgcgccaagcatccaagtacccactttcacatcatcgagtttggagtattcatatgaagcatcaatgacaaaatttggatgtggattaaattgtaatccggcaccgtatgccagagatgttttacttctactctctgattgaccaaatattgaggaaactttagcctttccatgacctgcccccaataatccatacaagctaacatactcgttaatgcggaaaacaggccccgcagtcactgagtagtacttaaaatcaccatcaataagtttgaatccgtcaacagattcctcgaacccccggcgagtctgagcaaatgaacctatcactccccagtcattattgaattcataacgatacttcaggttgaaacctcttggatttttatccaacttgtacccatcttccttgacacgactttgagcatatccaatagaaatactgctttcgccttcggcatacacattaacagacgcaattgataaacatgcaattaaagaagagaccagtaatgtcttattcataaaaaccatccagattgttataacaatacctaatacagtaaccacagactaaagtggccagccaaatattaacaaatatctgacacatgaaaatatggatatttgtacagtattccattacacacattttctcggtttatacaggccgatgttgaacagaaggataggggctagccgggcgaccattgccgtgacaaataagcatggacgactgcctcgcggaataaattcgaaatcaatagccccattgaccttgcggaccagataatgttgcagcgccagatgaccggtaaatgtcaaaataatgttgcagtgccggctcttcgcggggggaggcatgtcgagttgatacggttgaagggaattattttagtcgcgggataggcgcgtttttagcctatcccgatgagatcaaagccccggccaggaggccaggacggtgacagccgccttatgcgtaaaccggtaaacgagcgcagatagccagaactttctgtttcacacgctcaatggtcgcttcatcgttgatgttatctaacacatcacacatccagccagccaattcacgggattccgcttctttgaagccacggcgggtgatcgctgggctaccaatacgcacaccagatgtcacaaacgggctcttcggatcgttaggtacgctgtttttgttcacggtgatattcgcacggcctaaagccgcatcagcgtctttaccggtgatgtctttatccaccaaatctagcaagaacaggtggttatccgtaccaccagaaaccactttgtaaccgcgctccaagaacaccgccaccatggctttcgcatttttagccacttgctgttggtaaattttaaactcaggttccattgcttctttcagcgcgaccgctttacctgcgataacatgcatcaatgggccaccctggttaccagggaaaacagaagagttcagttttttgtacaagtcttcatcgccccctttcgccagaatcaaaccgccacgtgggccagccagagtcttgtgcgtcgtggtggtaacgatgtgggcatgtggaaccgggttaggataaacccccgcagcaaccagaccagcaacatgagccatatcaacaaagaaccaggcgtcaatgctgtcggcgatttcacgcatttttgcccaatcaacgataccagaataggcggagaagccaccgataatcattttgggtttatgtatttctgcctgacgtgccagatcttcataatcaatttgacccgactcatcaataccataggggacaatgttgtagagtttgccggagaagttcactggtgaaccatgcgtcaagtgaccgccgtgtgccagattcatccccaatacggtgtcaccgggtttcagcagcgcggagtaaacagcaacgttagcttgcgaaccagaatgaggttgaacgtttgcgtaatcagcaccaaataatgctttagcgcgatcgattgccaattgttcaacaacatcaacatattcacagccaccgtaataacgcttgcctggatagccttcagcatatttgttcgttaactgagatccctgcgcttgcataacacgcgggctggtgtagttctcagacgcaatcagttcgatgtgttcttcctgacgcacgacttcttgctccattgcacgccacagatctgcatcgtaatcggcaatgttcatttcacgctttaacatccggctctcctgacttagctaactaaatatacctataccctacgtcattggagttgcagccaggcagccaatgagcgagtcccgatgagctgacttgtgtcagtgattcgggtgacaaatctgccgggagcagatttgaacgcggcttgcagcaacctctgtgaggcccatggatgggccaagtaacgagaccgcgaacatcgctgcagcttcaagtacgaagggtataatggaacacccgtttgggttctgtcacacagtgtaaactgtttccccctcctgaagataggccttagcagaggtttttacgcaaacgattggctccagatagcataaggcttttagctgttcagacttcattcaatgcaacagaattatcctcatattcactatgtgaatttttcatcttcagcgagtaagtgcgttgatacgatccccctacaggtgaaaattacatttacaaagagaagagaaaaccataagatgcatttaaaatacatgtattaatttgtatattattaaaacacttaaggagccactatgctggatacccaaaccatcgctatcgttaaatctaccatccccttgctggctgccaccggccccaaactgacagcccatttctatgagcgcatgtttaagcatcaccctgaactcaaaaacatttttaatatgagtaaccaatcgagtggtgatcaacgcgaagccttatttaatgctatttgtgcttatgcgaccaatatcgaaaatcttgctgcgctactccccacggttgaacgtattgcccaaaaacataccagtttaaatattcagccagagcattaccctattgttggtgagcatttaatcgctacccttgatgaactattttcacccggtcaggccgttttagatgcctgggctaaagcctatggtgtcttggctgatgtgtttattcagcgtgaaagccagatttatcagcaaagtgagacggaaaccggtggttggagaaccttacgccgcttccgcattataaaaaaagagcaacaaagcgaggtaatttgcagttttgtcttggcaccggaagacggcggccaagtgcttcactataaaccggggcaatatttaggcatttatatcgagcatgaaagccttgaattccaagagattcgtcaatattcgctgaccaccgcgcccaatggcaaaacttaccgtattgcagtaaaacgtgaagaacaaggcacggtttcaaacttactgcatcgggagttaaatgaaggggatatcgtgcgcatcgcaccaccccgtggcgatttctttttggatgtatcaccagataccccggtagcactgatttctgctggggtgggccaaaccccgatgctcagtatgctcaataccctctatagccaacaacatgctgcccccgtacattggttacacgcagctgaaaatggtcgtgtacacgcattcgctgatgaagttagcgctatcgcagccaagatgcctaatctaagccgccatgtgtggtaccgcgagccagacctacaggataaacacggcgaggattaccatagccaagggttgatggatctgagttcgtaccagtggctagctgatgatcctaaacgacattattacttctgtggcccgctgccatttatgcaatttataggtcgtcaattactggcccaagggatagcacctgagcagattcactacgaatgcttcggtccacataaagtcatttaactgttcatttttatcctatctctacgcacttaatgccgctgatcaggaaggtacctgatcagcatttcggctatttcaattctcccatttattacatttacatttcgtggaacgtgacatagatctcgtatgtcctcaccatttattgccacgataaattcgataaaaggctatttaaatttttatataattgaagatttaaataacagctaaaatgatctttattattatttatacccacgcgacttcgaggcgcaggttggcggcaaccgagtaacaaatggtcaggaacccatttgcacagcatttatgctgcccacagggtgagtctcagggatgaagctcattaatccccggtcacttaaataactcagtgactgggggtgagcaagggcagctaacccctgcatcttgaaggacgacgggtatattgcccggtaacataaggctagatcgttacatcatgagtaaaagattcataaaaaaagaagggttagcattagtctctatggcgcgctatttaattggcgaacgctcaggaaatcgacttaaaactattgatgatctatcaggtgattttggtatttcagtcggtgtgattcaacacgccttgaaagtactggaagctgacggggctatcgtggttgaacgccgaggccgcaatggcacgcggcttctcgacctgaacatgacgcttctgctacaacaagccgatttaggcaatatggtgtgtgctatgccgctaccttacaccaaactttatgaaggcttagccagtggtttaaaagaacaattcaccttactccccctgtattttgcccatatgcgaggcgctgaagtccgtatcgaatgcctgatagacggagtctacgatatggctgtcgtgtcgcatttggccgctaaaaattaccttaaacaagagaaggtcacgctagcgctaaatttaggccgtggttcttatgtcgatggtcatcaacttatttttcgccgtggtgagcaaaaaaaaatccgccgggttgggtttgactcacgttcacctgatcaatgtttattgactgaaattaagtttgccgggcaaccaatcgaacgggtcgaattatcttacagtaactgcatcccgcaccttatccgtggcgatattgatgctgtcatttggaatcaggaacagattgtcccgtcagaatatttacagtcaataaagttacagggcgatgaacgctatattcaagcatcacaggcggttatccttatccgcccagataactatccgatcaagctactgctggaaagaggcattaaccaaacacagttactgcgccatcaacgggcggtacagagtgggatagtcgaacctcgatattaatagattaataatagtgaatagagacattagccagagaacgctgggctatataggttggattgtatatattgaattatcttattttgaattatattattttggattatatgtaaaaaacccgcatcgttttggcaacgaacgggcttttgttattcagcgtgagataaagccaacagcttaattaaatcgcttcttcatcctgctcaccggtacgaatacgcacaacacgggagacatcaaaaacaaagattttaccatcgccaattttacccgtctgggcggtttgcataatggcttctacgcaggtatcgacgatgtcatccgcaacaacaatctcaatttttacctttggcagaaaatccaccatatactcagcgccacggtagagttcagtatgccccttctggcggccaaaaccttttacttctgtcactgtcatcccggtaataccgacttcagccagcgcttcacgtacgtcatccagtttgaatggtttaataatcgcgtcaatttttttcatggtgaatccctgttttaccaattcttgcggccaaagcctgatgtgatcggatagcgtctatctttaccaaaactgcgggcggtaatacgtggccctacagctgactggcggcgtttatattcattaatgtcgaccaggcggatgactttacgcacgatagcttcatcaaaaccgtcagccaccagctcagccactgacttatcctgttcaacatatccttcaaggatagcgtccaaaatatcataaggaggcaggctatcttcatctttctgatcaggtgccaattcggctgaaggcggacgcgtgatcacgcgctgcgggatcacataagagaccgtattacggtattccgctaatttgaatactaacgtcttcggtacatctttcaggacatcaaagccccccgccatatcaccgtacagcgtcgcgtagcccacggccatttcacttttgttacccgtagttaatacaatactgcggcgtttattcgataaagccatcagaaccacgccacggcaacgagcctgaaggttctcctccgtggtatcgcgcccggtatcggcaaacatcggtgccaactggcccataaaagcatcaaacatgggttcgatagacatcacatcaaatttgacacccagtatttcagcttcttctttggcatcagcaatactgatatctgcggtatagcggaatggcatcatcaatgcctgaaccttgtctttgcccaacgcatcaaccgcaatggccaatgtcaatgctgagtcaatgccgccagataaacccagcactgccccattaaagccattcttggtgacgtagtcacgtaccgccaataccaaggcttcatagacttgagccagaggaggcagttccgccacaggtgccgtcatcgggatcacgttacactcatttaactgcaacagcgtggtttgctctgcaaatgcagccaaacgatgggtcatgttacccgccgcatcgaagactttggagcagccatcaaaaatcagctcatcctgcccaccaatctggttgagatacaccagtggtaagcccgtacgctggcaatgagcggccatcagcgttttacgaatatagggtttttcacgattataaggcgaggcattgatcgacaataccacttctgcgcccgcggctttcactgcatctatcggaccatcaagccataagtcttcacaaatcagtagacccaggcggtagcctttcagctcaacgacacagctttgatgacctgcggagaaatagcgtttttcatcaaatacgccgtaattaggcagttgttgtttaaaatagcgccccagcagtttaccttgtgcaaacagcgacagtgcattatacagcttatccccttcccgccatgggtggcccaccagcacggcaatatgcggggttgccgcttgcaaacgctcaagttgcacttcacaacgttgataaaagtcatcacggtacagaagatcttccggtggataaccggacaaagccagctcggagaacatgaccagatcggcacccgccttctgctgctcatttagggtttgcaacatacgttcagtgttgccttcaatatcgccgaccagccaattcaactgggctaacgcaatggaaagtgatctgctcattggtgtttaaactctgtttcagcattgtcagggaataatataccctcatctttcaaaaccacaggggcattggctggcccatcacgggccccgcctttaccaggccgcctgtctgcatcttgaaatctattgggtatcattgtcagtagctaacgatgattactctttaaaatcgttggcatccaactcgtggcgagacaacaatttatagaactcagtacggttacgccccgccatacgagcggcttgggtaacgttacctttggcaatttgtaatagcttacgcaaatagtttagttcgaattgattacgggcctccacaaacgtcggtaatacggtattttcaccctccagcgcctgctcaaccagcgcttcgctgataaccggtgccgaggtcaacgccacgcattgctcaatcacgttgaccagttggcgcacgttaccgggccaactggctgtcatcaaccgcttcatcgcatcgtttgagaaactgcgaacaaacggcttatgccgcttagccgactcccgtaatagatggtttgccagcaatggaatatcttccgcccgctcgtgtagcgccgggatttttaggttaaccacatttaaacggtagtagagatcttcacggaattcattctttgccatcgctttgggcaagtcacggtgagtcgctgaaatcacccggacattaatacttaaatcacgattgctgcccaatggacgaactttgcgctcttgcaatacccgcagtaattttacttgtaatgagagcggcatatcgccgatctcatccaggaacaatgtgcccccttcagcggcctgaaacaacccttcacggctgctgactgcaccggtaaacgcacccttagcatggccgaataattcagactccagcaactgctctggtaaggcaccacagttgatggcaataaaggcttttttggcccgtgggctggcggcatggatagcctgtgccaatacctctttaccggtgccgctttgcccgttaatcagcacactgacgtcagattgcgcgaccattttcgcttgttctaacagacgtagcatgaccgggctgcgagtcactatctcttcacgccaagtatcatcacccgctggaatcgaaagttctaatgccgcatcaatagccttatatagcgcatcgcgatcaacaggcttggtcagaaaactgaataccccttgctgggtcgcggcaacggcatcagggatcgaaccgtgcgctgtgaggataatcacaggcatccccggttgatatttttgaatttcagcgaacagcgccatgccgtccatctcatccattcgcagatcactgataacaatgtcaattttctcacgcattaacaaacgcaatgcttcgtgaccgctttcagctgtcgtgacattaaacccttcactggttaaacgcatccccagcaatttcaataagctgggatcgtcgtcaaccagcagtagattggccggtttgcgtggtgtcatgagattccttattagacgcaggtggtacatctgcaggccgaaccactggcggtgtatgcggttcagccggtttttctaccacaggtggtgctgatttactgcccggctgaactgcctcaggtttggtctctgccggcttcacaccggttgacttaggggcaaccggctgagcttcagttggtttggtgtctgttggtttggtgtctgttggtttggtgtctgttggtttggtgtctgttggtttggtgtctgctggtttggtttcagcgggtttactttcagctggcttagccgctgcaggctgattttcagcggatttagcctctgccgctgacttcgcctctgcatccgtttccggaatttcattttgtagctgcttacgcgatgaaagttgccgttcgatatcggtcaggttttccagcttgcgggtggtgtccaataagttgtattgcaaccggacctgattttcccgcagacgatcaatttgagcatctgattcatcctgtagccgttgataacgaatacgctcttccgctaaggcaatccgcaagacctgctgctcacgccacaattgaatgagtggccgcactgcaaccgggaaggtttggctataactattcagacgttcaaccacctgccgccgctctgccattgacggttcagcactgccgatcaaaataccttgtttaaaagctgaggaccaggttgttacgggcaatgtcttagccatcgcccgcgcctgtggcgagccaaggcgttcagcacaatccatcgaccttagccagtaaagggagttttctagtgtctctttgtcatccagcccccacaatacgtcgcaggataatgtccgataatcaacgatttttgtttctggtatcactaactgaaccgcttgggaaaagcggttcgcagcccggttatcagtacacccggtgagcaatagcggagtcagtaataacgctccccaaaaaatccctctgccagagagaccggtctgtttcacgactccactagatatcggatatgacaaagagacggtctttttaatcacacagcgtatagaccacttgtacattattcattcattctcggcggttaatggcaattcaatacggaagcagacggcggcgtagtcaacggttaccagttgcaaatcaccttgcatacgccggatacaatcctgagcaatgctcagcccaagcccgctacctttgacagccccttttcgctgatgacttccttggaaaaaaggctcaaatatcattatttcttctgaagttgggattggtgccccggtattcgcaacatcaatttgtacccgatcattcacctgacggctacaaatccaaatggtaccggattcctcaccatagtgcaccgcattggagtagagattatccaatacccgcattaataatgtaggctctgcccaacaaatgcgcgcatcgagctcagtctcggtacgaatcatcttcgcgcgcgcaggtaaactgtgggcagaaatcacattcccgaccatttcggccagatcaacatgttcaggttcgccggggccatcagctaacttacggttatagtccagtaattgctcaatcaattgctgcaaatggcggctactgtgatcaaggatcgccaccacctcttgttgatcttgtgttaatggcccggcaacctcatcggccaagagctccgtcccttcacgcatactggcgaggggcgtttttaattcatgggagatatggcgtaaaaattcatggcgctgtgactctagccaggctaaacgttcactaagccaaatgatacgctgtgccaatgagcgtaattctcgaggtcctttaaacagcgccgtattgcccagagaacgcccttcgccaaggcggttaatcattctctcaatgcctttgacggggccgatgatcatgcgggtaaaaagaaccaccagcagcacactgaccagaaacagtaaaagggactgccagccgaaaaattgcccacgttcggcgatatctttctgtaactgttgaccacgagaaaaaataacatcgcgagtcgcttgtaccatttcggcatttgagcgagagaactgctctaataaaatggatgcttctttgtcagggccgctgtttttacatttaatatcagtaagctgattcaacaatccttgcagcgtctggtaatagcgggcatccgggagtataggggcgtgggccatgagcatttgagtatattgcttacgctgatgctgatataacgtcgccagtgttgcatcatccaacacacaatattgacgatagctacgctccatctcaagcgcgacactggtcatggcctcgctacggcgagcatctgcaagcgttgtacggttaatatcggcggcttgagtactcagatggtccagactttgataggcctgatatgccagcaccaataaaggtagcagcaccaatagaaatgccataaggactaattgacgtaaagaacgggggaataaacgccatcttttcaacgaaatcatctcattacctatcactttgatgtgatgctaactgactcagccaagattacaatgcctgctccccaatttatgctgccctatccaccaccgcatcctttggttgaaataacaaaaaaaagcacttgctgcgagcaaagtgctttttttaaaggttgttgatcccaaaccgtcagcatcatcatcagacctgcttattattgtcttaaacttgcttgttatagtataaaatttgctcgttataatatcagatttgcttgttacagtgtgtttcgacggggatagacaactaaacattgatcaacggggcaataaattgccccgttgcaagaatatgtggatgcccttaagcatcgtctccagtttgatgaagccgaagcaatcatcggaaggatgagacgaatagcatccatatatgtccaaaattgatgaacaattcatcacagcaggacataggcggtgcctcactcaacgtgtcgtccgatgtttgataatgtgctttcacacaatgtcggtttaggtggacgataggcaccagtcttaggcatcattcggaggcttatgaagcgcatcatccgcttaattgcggggctatcataaaaaggtgaatgagcaactgttattgataatgcagttagcgtgccaagtttaaataaatattattaatatattgatttaaaagagttattagtattttttttaataaattttttaataatccttagaaaaaaatattattaactgatgttttgtcgctgcttcacgacacttaatcacctttaaattaaaactcatataaatcaattaattaaatgtctcctatttgagacattaatttaacctcctgtcgcaacttgccgacagaatataaaaaataactttaaatcagtcagttaaaaacatcatctcctgttttttaatatcagtgtcagctatcccccttctcgcaacgcgacctcttgtgtgactactaaaatcactattacgttataaattatgagatttcatcacaacaaggaatgagtcactctgtagacctgactcaggtgctgatttaaaacacagccaaagagcagattgcgaaaaagtggcatccgttcatcgaggcaagcgttcattgatgcaaacgttcattgatgcaagatagcggtgagtgactgctgcaaattttcgccccccataaaggaagatattcacatgaaaataatctatatcacttttgcctctgcggtgttgttcagctcaccatcgctagcatataacccccttttctcatcatttcctcccatttattgggtatataattcccccacagcgaccacttggcttaagcttgaaaatcaatttaacccactctatttgatgactagatccttttggtttacacagcatggcaattcagcccaacaattgacaaatctggcattaataaccagtaatggtgctgtatctggcaatttttcaatagagggagtccaaacgaattattggcttgatcgcgggcagggacaaatcgagataacagcgacaacccatgaacatttgttgataaccgcttatctctttgatgtgaatggtcaggaaaaagcacaaaccgcgacattaattaataatcgaacaaaaaacctgatattactcttagataatatcgtggcaggaaattatcggctggttattaaagcgttagccactgaccatcaaaccgccattaaaaccttccacataaccttagccgatatcgttccccagacacgctagtcactaacaaaaaagatagcgtactgcctatataaaaattaacacccaacaggaagagttcttcctactcaatgggtatgtgctaaatatatccattatccacaatcaaacaataatatttacggagagatccaatctttgagaaagtattaaaagtcaaatagcagcattcataaaaaaattattaatgctgttatgccaaaaataattcgagttgtagaaaggcggcaattgagtaagtcctcagaatttattttaaggtcaacaacaagtcagtgacttggatgacaacggttattgacacctagcgccagaagcagatttgaacgctgcttgcagcgacatcaaagaggtgagacccatagatgggccgagtaacgaaagcagccgacatacatgcagcttgaagtctgtcgggtatatattattaaccctcaacaaaggtactataatgaataaatataatagcgtattcctccttgttactctcagtgccgccattatctctttcaatactcgcgctgcagaacatggaatgatcacattgaatcaaaactcgggtaacctgcaacctattagccccctagttctcttggccgctgaaaatggggttctcccttcatttgaagttcaacatttagcaaatagttataatcgatatggcaacaaagtaaaaatagagtttaccatgagctctgaacaattaataaattattatatttacataaccaatagcacaggggttaattattatgaaacctctggatttattaataactcacaaaaaaacatcaatctggaaattgaagacatccctttggggaattataacctagtcatcaacgcctataataatgatcagaactcaatgataaagagatatcagatcgatataaaatagcaggtaataaaaataacttcatcaagtcgatgattaaataaaataaaataaactatatacccaaaataatttgagttacagaaaagcaacaagggagtaagttccaaggagtttacacaagtgagtaactgaagttattaagcgtagtcaatgcacatgtagcttgaaatataacgggtataaattgataaagagaagggtatcttcaatacccttcagactgctgacaaaccccgatgacgcgatcttgaacggtgaggataggcagaggagtaaagcgtccgcgccaagaatggcgcggctcgagcctacatggatgtatttacggcgtctttacgatctgcctgttctctccgtcgcgggcactttgtcaataacctcaagggtatcttcaatacccttctcactttaacttattaacctaattgcttacgcgcattacggaacatacgcatccatgggctatcctcgccccactcttctgggtgccacgaattactgaccgtacggaacacccgctcagggtgtggcatcattaccgtggcccgcccactaacactggtcaccgccgtaataccattcgcggaaccatttgggttagccggatattgctcagtgacaaccccgtggttattcacaaagcgtaacgccaccagatgactctgttccagagcagccaaatgtgccgcatcacggacttccacctgcccttcaccatgtgaaacagcaattggcatacgtgagccgaccatgtcctgcataaacagtgatgggctgcttgccacttcaaccaggctgaaacgtgcttcaaagctatctgataagttgcgtacaaaccgtggccaatgctccgcacctgggattaattcacgcagattagacatcatctgacagccgttacaaaccccaagcgccaatgtcgttgggcgatggaagaaagcctcgaattcatcacgaacacgatcattgaacagaatggattttgcccaaccttcaccggcccccaagacgtcaccgtaagagaacccgccacaagcaactaaggtttggaaggattgtaaatcagtgcgacccgccaacaggtcactcatatgaacgtcgaccgcatcaaacccggcacggtggaaagccgcggccatctcaacgtgagagttaacgccctgctcccgcagcacagcaacttttggccgcgcctgtttgaggatgaatggtgccgcgatatcttcagcggggtcgaacgtcagtttcacattcaggccgggatcactttcatcctgtttagcctgatgttcttgatccgcacaatccggattatcacgcagacgctgcatttgccagctcgtttctgcccaccacaagcgcagagtgctgcgtttctcgctgtacaccacgtcagtaccactgcgaatatcaaaggtatcgcccgcaaccgcacgccccagatagtgaacacaatttgccagaccgtggtcagccagcaatttctccacgtcggcacgctgctcagcacggacttgaatcactgcacccagttcctcgttgaacagtgcagccagagcatcgttacccaaagactgaatatcaaccgttacgccacaatgccctgcaaaggccatttcggccagcgtgaccaacaagccgccatcggagcggtcgtggtacgccaacaaatgttgatcggctactaaacgctgcatggcgttgaagaagccagccagttgctgcacgttacggacatccgctggtttatcacctaactggcggtaaacttgcgtcagcgcagtcgcgccgagcgcattatgacctgcgcccaaatcgatcaacaacagcgcgttatcacctttatctgtacgcaattgtggtgtcacggtgcggcgaacatcttctatgcgagcaaaagcggtgatcaccagtgacagcggtgaggtcatttcgcgctgctcgtgaccttcctgccagcgggttttcatcgacatagaatctttgcccacaggaatcgtgatttccagggctgggcacagctcttcacctaccgcacgtaccgcgtcatacaaaccagcatcttcccctgggtgaccagcagcagacatccagttagcagataacttgatacgctttaattcaccaatttgggttgctgcgatgttcgtcaaggcttcaccaaccgccaggcgggcagaggcggcaaagtccagcaatgccaccggagcgcgctcgcccagcgacatggcttcgccataatagctatcaaggctggcactggttaccgcgcaatcagccacggggatctgccaagggccaaccatctgatcacgggtgaccataccggttaccgtgcggtcgccgatggtgatcaggaaggttttttccgctaccgccggtaaatgcataatgcgttttaccgcctcggcaaggctaatatcagcccgttgcagcgcgtcacccttagcctgtaggcgggtaacatcacgcagcatcttcggcgttttgcctaatagcacatccagcggcatatcaatgggttgattgccgaaatggcgatcattcaggagcagatgtttttcttctgtcgcttcaccaatgacagcatacggtgcgcgttcacggcggcaaatttcgtcaaacagggccatctgtgcgggtgcgactgccagtacataacgctcctgagactcgttacaccacacttccagcgggctcatacccggttcgtcgttgaggatatcccgcaattcaaagcggccaccacggccaccatcgttgaccagttcaggcatggcattagagaggccaccggcgccaacatcatggataaacagaatggggttatactcgcccaactgccagcagcggtcgataacttcctgacaacggcgctccatttctgggttatcccgttgtaccgatgcaaaatccagatccgcatccgactgcccggatgccatagaggaagccgcgcccccccctaaaccgatattcatcgatgggccaccgagtacgaccaatttggcccccacggtgatttcacctttttgcacatgatcggcacgaatattacccaacccacccgccaacataataggcttatggtaaccccgtaattcaataccgttatggctgttaacccgctcttcataggtgcggaagtaacccaacaacgccgggcgaccaaactcattgttaaacgcggcaccgcctaatgggccttcagtcatgatatctagcgccgtcacgatacgatcaggcttaccgaagttctcttcccacggctgctcaaaacctggaatgcgcaggttcgaaacggagaaccctaccagccccgctttaggcttggcaccacgcccggttgcaccttcatcgcggatttcaccccctgaaccggttgctgccccaggccacggtgaaatcgctgtcgggtggttatgagtttcaaccttcatcaggatatgggcttcttcctgatggtagtcataaatccctttctccgccgtggcatagaaacgcccgacctgagagccttccatcaccgcagcgttgtctttatatgcagacagcacataatcaggggtgtgttcgaaggtgtttttgatcatcttgaacagggtcttcggctgagcaacaccatcaatgacccaatccgcattaaagattttatggcggcaatgctctgagtttgcctgcgcaaacatatacagctcaatatccgttgggttgcgccccaaaccggtaaaagcggtcagtaagtagtcaatctcatcctgcgccagtgccagacccaatttaatattggcctgctccaatgcactgcggccctgccccagaatatcgacccgttgtactggtgccggttggtgatgagagaatagctgctctgcttgctgtaaatcggtgaagacagtttccatcatgcggtcatgtaataacgccgctaattgtttccactgaccctcgttcaaattcgggccttggatagagaaagccaaaccacgttctaaacgtaaaatttgtgataatccacagttatgtgcgatatcggtggctttagaagaccatggagaaatagtacccggccttggggtgaccagcagtaaacgccctgcgggtggatgctcgggaagagatgggccatattgaagcagccgctggagtctggcgtgttcatcagcactcagtggggcgctgacatcagcaaagtgaacatattcggcgtagatatcactcaccggcaggtgagcatcctggcaacgggacaacagtttggtgatacgaaaagccgacaaagcgggtgaaccacgcagtatttccataatctaagtttctctcgtcttcgaagcggctggaacagcacttcattgggcgcaacattcattggcgcaacaacagggcaaaacgcgcgccattatagtgaatctgagccgccgacgaaaccgtttgcgtatctattattaataattcagtcagaaacagccgctatgtgtgtgtaacgcagactcagcaaatagctcgcaataaagttgcacactggcgttttgttgcgcaaaatgccactccactggggatttaaccatgttgaatttagctttaccgcacacacgaagagagcgtttccgagagataactatttgacacgcataaaattaagttactttaccatcggtctggttgctctgcttctggcgcttgcgctgtggcccaatattccttggcgtaatgggcaagagggccaacttgaccaaataaaagcccgtggagaactgcgcgtcagtaccatcagttctcctttgatctactctaccgaaaaggataccccttccggttttgactatgagctagcaaaacgttttgctgactatctgggggttaaactggttatcatcccccatcataatattgacgatctgtttgacgcattagataacgatgacaccgatctgctagccgctgggctgatttataaccgtgaacgcctcaatcgggcgcggactggtcctgcctactattctgtttctcagcaattggtctaccggctgggttcgccacggcctaaatcgttcagcgatctgaaaggtcaggtggttgtggcctccggttcggcccatatgaccacactaaaacggcttaagcagacaaaatatcctgaactcaattggagttcatccgtcgataagtccggtaaagaattactggagcaagtcgcggaaggtaagctcgactatacccttggcgattcagccaccattgccctgttacaacgcattcatccgcaattggcagtcgcatttgatgtcaccgatgaagagcccgtcacctggtattttaaacagagtgatgacgatagcctgtatgcggccatgctcgatttctacagtgagatggtggaagacggtagcctcgcacgtctggaggagaaatatctgggccatgtggggagttttgactatgtcgataccaaaactttcctgtccgctatcgataatgtcctgccttcttaccagcacctatttgaaaaacatgcaggggacattgactggaaattgctggccgtgattgcctatcaagaatcacattggaacccgcaagccacctcccctactggtgttcgtggcttgatgatgctaacccgtgtgaccgcggacgggttaggggtcaaggatagggttgaccctgaagaaagcatcagaggcggggctatctatttgcaacggctgatgaaaaaactccctgaaaccatcccagaagatgagcgcatctggtttgcactggctgcgtataatttaggctatggtcatatgctggatgcccgccgtttgactaaaaatcagaacggtaacccagacagttgggttgatgtgaaaatgcgtttaccgatgctaagccaaaaacgctactacccaagcaccacttacggttatgcccgtggtcatgaagcctataactatgtcgagaatattcgccgttatcaggtcagtctggtgggatatttacaggaaaaagagaaaaaagcggctcaacatgccgccattgaggcggagctgggcaaaagcaacccggttgtcggccccggttggtcaatcggtgactaatcgctagccagtaattcgtctgttatcagtcactcgtcggcagtcgttcaaccttaattacaccgtgatttagtcaccaaccgccgcccgtcataacatgctgggcggcgcatcacctggccgccgtcagaatttaccttctgctgcccgctgtgcttgtttcaatgctttctgctgctcacggcgttggcgaaagaacgcactcaattgatgggaacacgcagtcgccagtatgccagcactgacctctatttggtggttcatcccagggtggcgcaaaatatctaccagcgaccccgcggcgccagtttttacatcatttgcgccataaaccaaccggcggatccggctgtgtaccatggctccggcgcacatcacgcaaggttccagcgtcacatataaggtggcatccaacaggcgataattctgtaccgcctgcccaccttggcgtagcgccataatttccgcatgagcagttgggtcattatcgcgaattggccggttccacccttcaccaatcaccttattccccaagaccagcactgcccccaccggaacttcaccctcttcctgcgctcgcagcgccagcgttaaggcatggcgcatccagtactcatcgctgtattcagcaggagaatcacattcagaagacaagacattatcagcaggcaaactattatcagcagacacattaacctctctggcacttttgcggcgggcattatacacagcttgctggcgagtcggttagtttgtcgcaaaacaggggggtgctttggctagtggctaaaatggctcgctactccaattgctgtaattcgccggttttacttacccgccagcggtgttcgcaaaaagctaacagcggattatcctgcttactgtcgctgtacccactatataacttcagtggagaccccagacgctgttctaattgcaccactttttcaggccctaaacaacgtagtggcaacacccatcccccattgcgccgttccatgcggctacctatcaaccgtaagcggtgtataaagtttgaatcatggtaaacctgttcgaccagccgctgtggggagccggtgattaaccacacctctgcatcgctgctttccagatactggcgtaagcgcatagcaaccacggggaattcagtcactttttggcgaaatgcggccacaaagcgccactccaggtcgcgcagatgtgcttcccgtcgcccaaaagtcatcgcccacaacaagaggctcatcggccaacgtgcacaacgcccccccaccaggagccctacgccaattagtggtagcaacgggataaccagtaacagattaagcggcaagtggcgtaatagaaaacgcaaaaaactgccgaacatatcctgttgatgtaacgtgccatctaaatcaaaaaagataatgcgtttcgccccggctgattgcggttcaaccaccccatcagccctatttctatcgctaacatctgcttgctttacgctcaaaaagcctccttaaaatcatcaagataaaacccaataatgcagtgatagctattttcgcttcaggtcactttagcaagctaattatcctcagaatcaaaccagagacaatgaacgcagccataataagaatgaatatactgatcactagcttcatgattcaataatgggtgttacgcattttgaatacagctaatttatccattgccaatgtcttgaatgtgagcctttatagagctgcgcgtaaatagccatgatgttgccgtaaatcctgacgcgcctgctcagcactcacccctttcaagagcatcagaatggcgggtttgacctcaaaatctgtttgtctcaacgcgtgttcagcctctgcccggctgacgcccgtggcctcgacaacaatacggcaggcacggtcaactaacttcacattggttgccttcacatcaaccatcaaattttgatagaccttacccagtttaaccatagccccggtggataacatattcagcaccagtttctgtgcagtccctgatttcatccgggtcgaaccggtcaatgcctccggccctaccaccggtgaaatcgcaacctgcgcttcctgcgcgataggggaatctggattgcaagaaatggcggccgttgggcaccccaactcacgggcataacgtaacgcaccaatcacataaggcgtgcggccagatgcggccagcccgaccaccatatcggtggcagtgagttgcaaatcttgcaggtcccgcatccccagagctatatcatcttcagcgccttcaaccgctttgagcaaagcccctgggccaccagcaatcaggccaataaccataccatggggaaccccgaaggtcggcgggcattcagaagcatccaacacaccgagtcgaccactggttccagcgcctaagtagatcaaccgcccgccctgctttaatgcatcagcagctaaatccaccgcttgagcaaccgccggtaagaccaaacgaatcgcatctggtactttacggtcctcgtcattgatacaggtcagcatcgccaacgtagagagtttatctaattccatggttgccggattacggctttcagaaattaatgctcccagactcatagcccactccttattgaatttttaattcatcgttatctagttatgattgaatgtaatattcattaaaacaaacactttactccccctttcgctcgcaactcacaaaaaagtgtagtcaacgctcataactcaaccttttgccataagtatttataggtatcactcataaacatgtcagaatacctccccaaacacaggaactgatttatgagtagcctcctacgcatccgccaaatttattccacgctggcacaaaatgaccgtaagctggcggattttttgctgattaatcccgagcaggctcgccatctcagttcacaaaagctggcgcaacagaccggtgtcagccaatctgctgtggtcaaatttgcccaaaaattaggctataaaggtttccccgcgttgaaactggccctgagcgaagtggtcgctatgccgaaggcggtaacgctgcataatcagatcttgagcaccgacagtttaaaaacaattggggagaagttgctgaacgagaaaaccgcagcactgcgagcaaccctagacattaatagcgaacaacgtctcatccagggattagggatgttacgcgcagcacaaaaggtacttttaatcggcattggtgcctctggtttggttgccaaagatcttgcctataagttactaaagataggcatcgtcgccatctcagagacagatatgcacgtgcaattggcggcagcacaagcgctgggagaacagggtttactcttggcgatctctttcagtggcgaacgtcgtgagatcaatctggcggcggaagaggcacaatattgcggtaccaaagtgttggcgttaacccgcttttcccctaacagcttgcagcagcgggcagatcactgcttgtataccatttcagaagaaccggttatccgtagcgcggcgatctcttccagtaccgcacaatacgcactgaccgatcttttgtttatggccatgatccagcaagacattgaaaatgcgcaagatcatattaagcacagtgcagcactgatcaaaaagctgatctaatggtaggcaacaaaatagcttacttgcgcattttggtgtgactcacttaagttgtttaatgcataatacgcgatataaaaagtaggttatgtaaagtggcaagcgatgagacatgtcattaactgcatgatttaaaaagattaaaaaggtaagttactgaaatggctttattgattactaaacgctgtattaattgcgatatgtgcgaaccggaatgcccgaatgaggcaatctccatgggtgcagaaatctatcaaattgatccgatgcgctgtactgagtgtgtaggtcattacgaaacgccaacctgtcagctggtctgccctattgataatacgatttctgccgacccagcttgggttgagactaacgagcagttgtgggataagtttgttcagctacaccatgccgatcgtctgtaataccgctcgtcatacctcctcgctcatatcaacaagccccagtatgcaaaaagggatggcatttccatacccatcccttaaattttcggctatcacgctcagtggttaactttcaataatcactgtcgcgcaggcataacgtcgctcatcagccagagtgacatgcagcgatttcacccctaattctacagccaactccgcggcccgcgaatgcaaacgcagtgtcggtttccccaatgcgtcgttaaccacttcgaattgattaaacgccaacccattgcggatgcccgttccaaatgccttagcggcagcttctttaacggcgaaacgtttggccaaaaagcggaccggttgctgatgctgttgataatgttgccattcagacgggctgagaatacgccgcgccagcctctcaccagtacgctcaacaaccgcttcaatacgtgagatttcaacgatatccgttcctagcccaagaatagccattaacggcgcgcttcccgcatcaataccttcatgtctgtcactgcggtagcaaggcctgtcatcacagcctggccaatgatcgcatgaccaatattcagctcatgcatttctggcaatgcagctattggctgcacattatggtatgtcagaccatgacccgcattcactttcaaccctttgcctgcagcataggtcgctgctttggcgatacgcattaattcagcctgacgttccagaacggtcgaggcatcagcataagcaccggtgtgaatttcaatataaggtgcgccagcggcaacagccgcatcgatttggcgaaaatctgcatcaataaagagtgaaaccagtatgccaacatccgctaaccgccctaccaccagggtcattttatcaacctgaccggcaacatctagcccgccttcagtcgtgacttcctgacgtttttcaggtaccagacaacaaaaatgcggtttgatatcacaagcaatatcaaccatttcatccgttaccgccatttccagattcatgcgagtctggatggtctgacgcaaaatacgcacatcgcgatccgtaatatgacggcgatcttcacgtaaatgtacagtaatgccgtcagcgcccgcttgctcagcaataaaagcagcctgaaccggatcgggataaatggtcccacgtgcatttcgtagtgtcgcgatgtgatcaatattaacgcccagcaacaaatcagccatgacagccctccaaatatggatgcatctttaatcggttaataagcatataaataaagcataccaataaccacgtcagtgattttcagtttacaccgactagaccagcagcggataggctacaccacgggaaagttaataataggcagtttaaagcagcgctagggtgaaggatcggctggaggcttaatcacaaactgacgaaatagctcgcgactctttaaaggtttaccgcccagataaggtttgagggcgatacgggtgaaacgtttagccgcgcgcaaagtatcggcgtcaggaaactctcgattagctaaagctaacaattgacggccggtaaagctgtagtgatcgaccaccagactggcaataaagcctttctcttcccgataacgataggtcatggtatcggataccggctgcccgctaccggcacaatgcagaaaatcgacgccatatcccagattcgccagcatcgccaattcaaactgacgtaaagcatgttcaggtgaaccatcgctccccgccaacgcttgtaagcagtgcagataatcgaagaatagggctgagtagctggtttggtgctctaacacgcgggaaagcagctcattaacatataagccgctgtataacatagaaccgctcaggggaagagccagcgatactggctccgcactgcgtaatgttttaacttcaccacgccctgaccagcgaaccaataacggcgtaaaaggctgcaagcagccttttaaattggaacgacgcccacgcgcaccttttgccagaacccgcatgcgcccttccccttcagtaaataaatccagcattaagctggtttcactgtaaggccgcccatgcagaacaaatgcgcgttgccaaccgtccatcggcaagccttatttcaaatcgtcggtatagcctaagctgcgcaatgcacgttcgtcatctgcccagcctgatttcactttcacccacagttcaagatgcactttagcttcaaacatccgctccatgtcctgacgggcttcggtaccgattactttgattttgctgcctttgttgccgataaccattttcttttggccttcgcgctcaaccaaaatcagaccatggatattatagccaccacgttcattcggcacgaactgctcaatctcaaccgtcaccgaataaggcagttcttcgcccaggaaacgcatcaacttttcacgaataatttccgacgccataaaacgctgggaacggtcagtgatgtaatcctctgggaagtgatgttcagcttccggcatatgcttgcgcacaatgctggcgatggtatcaacattcattcccttctcagctgagattggcacaacgtccaggaagttcatctgctggctaaggaactgcatatgcggtaataacttggttttatccgttacgttatccactttgttgatggccaataataccgggcattgcaaactgcgcagcttattaaccaccatctcgtcatcagcagtccaatgagtaccttcaaccacaaaaatgactaattccacatcaccaagagagctacttgccgcacgattcattaagcggttaatggcacgcttttcttcaatatgcagcccaggggtatcaacataaatagcctgataaggcccttcagtgtggatccccataatacggtgacgtgtggtttgcggtttacgtgaggtgatggagattttttgccccaacagctcatttagtaaggtcgatttgcctacattcgggcgccctacaatggcaataaaaccacaatacgttttttctacttcgctcattcaagctccaactgtttcagcgcttgttccgctgccgcctgctcagctttacgacggcttgagccagtacctattactggttcattcaagccactcacctggcagtggatagtaaattcctggtcatgtgcttcgccgcgaacctgcacgaccagatatgaaggtaatggcagatgacggccctgcaaatactcttgcaagcgcgtttttgggtctttctgcttatcaccagggctgatttcctctaaccgactgtgataccactcgaggatcagccgttcaatcgtatggatatcgctatctaagaatacaccgccaattaaggcttctaccgtatcggctaaaattgattcgcggcgaaaaccaccactcttcaattcacccggcccaaggcgtaaacattcgccaaggtcaaattcacgggccatttcggcaagtgtattccctctaaccaatgtggcccgcatacgactcatatccccttcatcaacgcgagggaaacggcgatatagctcattggcgataacaaaacttaatatagagtcacccaggaactccaaacgctcattgtgtttgctgctggcgctacgatgagtcagtgcttgcagcaagagctcctgctgttggaaagtgtagcccagcttccgctgcagcctgtttattacgatgggattcatgagttaccaatagatcaagaatgcgtcaaaaactacagcatacggaacaggtctgaccgacaaaaataaccaagacaaaactgtttcgtttgcagtggctcccataagagagccaactttatcgctcgaaaggttattctacaacgagtggatatataatgctgcgtttatatgccctcctcatttgaagttacagcgccgcaagtggctctcattcacctgaatcactaatctggatcccgaatcattcacttgccccgagtcactcactgagagagctcatcggggttcactcaataacggccttactgcctaactgcaacatcaacggcttggggaatatccactgctttagtgaattccaccaattcggcttaaacgcacacccgttggccattcaccttcttgcttttcaaaactcatccaaatagccgtagccttacctaccagattacgttctggtacaaaaccccagaagcggctatctgcactgttatcccggttatcacccatcataaagtaatggccttccggtaccacccaaacccctaacggttgatcgggttgctgataataagagcctaacggatcctgccgccctgggacggtcagaatgtgatgcgctaccgggccgaggctttcagtatgctcacgtaaccggacaccgccatcaggtactgcctgatttagcgggattgggaagaaccctgcggagctttcgccattaccgctataacggaatgtctgcacaaactcacttggctcagacgtgctgtaagtgatggccaacgcactatcacaagaagtaccggtattacatgacggttgtaccgtgacttctttacttatcgggttataaattacccgatcccccggcagccccaccacacgcttgatataatccaaacgtggatccaacggatatttaaacaccgcaatgtcaccgcggtttggcttacctgttggaattaatgtggtctgagtaatgggatctttaatcccataagcaaatttctcaaccaaaataaaatcaccgataagcagcgttggcatcatcgaaccagaagggatctggaaaggctcgtaaataaacgaacgcacgataaagaccaaggccagcaccgggaagatagaggcacatgtctcgatccaacccggttgctttgcagcttgggctaaggttttattatctacggcacacccggtttgggccttgatttccgcagtttgtgcattaactgccgcaatttttgcctgacgggctggcccccatttaaaccgctcgaagcaccagataatccccgtcaacagcgttgctattgccagaatcaaagcaaacatgttagccatgaaaactccttatttactgtcttttccaacatgcagaatagccaggaaggcctcttgtggtaattcaacgttgccgacttgcttcatacgtttcttaccgtctttttgtttctgcagaagttttttcttacggctaacatccccaccataacacttcgccaatacgtttttacgtagctgttttaccgttgagcgagcaatgatgtggttaccaatcgcagcctggatcgcaatatcaaattgttgacgtgggatcagttctttcattttctcaaccaaatcacggccacgatattgtgcattatcacgatgcgtgatcagtgccagcgcatccacacgttcgttattgattaatacatcaacacgtaccatgtcagacgtctggaagcgtttgaaattataatccagtgaagcataaccccgtgacgttgatttcaaacgatcaaagaaatcaagcacgacttccgccattggaatttcatatgtcagcgcgacttgcttaccgtgataaaccatattggtctgtgtaccacgtttttcgatacacaatgtaatgacgttaccgaggtattcctgtggcaacaacatatggcattcagcgatcggttcgcgcagttcttcaatattgttcaacgcaggcagtttagaagggctatcgacatagaccgtttcctgattagtcgtaatcacctcgtacaccactgttggtgccgtagtaatcagttccagatcatattcacgctccagacgctcctggatgatctccatatgtaacaagccaaggaagccgcatcggaaaccaaaacctaatgctgtagagctttctggttcatagaacaaagaggcatcgttaagacttaacttacctaacgcatcccggaaagattcataatcatcagagcttatcgggaacaggcccgcataaacttgtggttttactttcttaaagccaggcaatgatttttctgccgggttacgcgttaatgtcaatgtatcgccaacaggtgcgccaagaatgtcttttattgcacaaaccaaccagcctacttcgccgcagttcagaacatcacgatcaacacgttttggtgtaaatatccctaaacgatccgcgttatagctctggccggtactcataaccttaactttatcgcctttacgcaacgaaccattcttgatacgtattaatgacacaacacccaggtagttatcaaaccaggaatcgataatcaatgcctgcaatggcccatttggatccccctcaggggctggaatatcgcggaccaaccgctcaagaacatcaggcacgcccacaccggtttttgccgagcaacgaatcgcatcagtggcatcaatccccacaatgtcttcgatttcttcagcaacccgctcaggatcggcagcaggcaaatcaattttgttcagaaccggaacaacttccaggtccatttccatcgcagtgtagcagtttgctagcgtctgagcctcaacgccttgccctgcatccacaaccaatagggccccttcacacgcggctaaagagcgtgaaacttcataagagaagtcaacatggccgggggtatcgataaagttaagttgataggtttgaccatccttcgaatggtaatcaagcgtcacactctgtgccttgatggtaataccacgctcacgttctagatccatggaatccagtacctgtgcggccatttcacgctcagataaaccgccacagatctgaataatccgatcagacagcgtcgacttaccgtggtcaatatgggcaataatagaaaagtttcttatgtgcttcatttatatgaatttttctctagtcgttgtctttaattaattattggtggacacagcgatggattcaaacccaaaactacccacataaatattcacgcatcttacactgtaagtcagcctcgtgaaaggcatcacacttagcttgttacctgatttatcctctacaaaggctgtattccccttcgtttgaagccagggaagaaacccgcacagtatcgtttcagccgttatccgataaagcgctggctaatcaccctatttatatagaatgtcgattagccgctataactgtaaaatttattttctgataatcatctaatgaataaacgcagtctgatcatcttgatgatattcgagatattctgttacaacctaaaaaatactctgccactttaggaaaatgctcatatacccaccaaggaaaagacatacagttacagcattagtgtgattttataataaccaagtgaaatattctcttggcggtaacgaggagagtattatgattgacgaaggaaaaatactgagtcgccacgaaatgagaaatgaaaatgcatgggttacccttgctacaataatagctatattagtatttagcactgtaattatcacccttgcgctcacgacttcaatattcttaacaccgtcaattctttctatcttatgcgttgctatcgctgcagtatcactgagtgcactactttatttacgtttgtatgacaacccactatttacttattttctctatgaaaatggcgttagagttttcaaccataacaatctggaaatttatttcatcccatctgataaaattcaatatatttataaatatcacacaggaataaaccccaacgggaagattaatgctatggcatttcgaacatctaaatctcagccatggaacgttatcattaataacatcaataatgcatatctgttgattaataccatcattcatcaacaaatcatgaggataggcgtaaaaagcttaaacagtttatcacacggtgaaacgctgacatttgatattattaagaaagaggagtgttggttgaaaagactgatatatcatggagagattaaaatgggtatcgggagaataaacactcatcagatggatacatactcactatcactcagcgcacacacactgatcacaattaacggcattattaatattgagaatatttttcggatagaaacattacaaaagattttcatgacaaaatacgcttattggatactcaaggggacattattttttcaatagactcgtctgatttaatcaatgcagatctttttattgttttgatcgaacatatgatacagaaccgcattcctgcttatcatgcctaatcaataataacgtcttattattactgaatacgcatagccgttggtggcaaaccgatttgcaaaataacaggctgataagcactgagcccctcaattctggttgccagttttcgtgccagtaaaaaacctaaccctgcgcctaaaatagccccaagagcggtaaatgcatcggttaaaaataaagactggaacagtgccccaccagcaattaacccaactaacggggttaaataaaccaatgatgcagaacgtaataaactcccttcactgatgccaacttcaactttctgccctggctcgagcggttgtgaaatttcaacctgtaattgatggtcggtctcaggccctaactcatttaataaatggctaccacatcctcggcgagaatggcaattcccacaaccagagtgtggttcacaacgtaatagggcaataccattttgccatgatatcaccgtcgcccattccttcatcattttgtcgactccagaaccacactgtcggcaatacgtttggccgttgaaggtggcaactcacccactaccgttatctcgacgttattacggacttcagtctggacagtacgccgcccctgacgcagggattgttccgaagtcccctccttgcctgcgggattcacattgactgaaaaactaaacaaaccatcggtatacaagcgagactctgtgggtgcatccatattcggcagtgtacggcgactacgtgaaacctctgcgaccccctgcggtaaccaacgcggagcccaggtaaaatcaactttagtcttcgctggcaacgacagtaatggtggcaaggctaatttcagcataccttgtaagacttgctgaataggctcacccaccacaaaagagataacacggaattgctccagtgtttcgccatcacgatccaacaaatctatccgcattggcagtttcgttgcctcatccagccaaataatatagctgtaccgagtactgtcattagcgaccactcgaatcacctggcatggcctatcagccacacgtgcccggcctaacgcaatatagttatacgtcttggatagtttttcaaaattggagaaaacaatagacggcagagcatcaacaatgtgctcaccggacaacgtgaaagattcaaaaccgggctcgaaatagcttatctcattgccacgctgtaaaatttccgtacgcggaccgtccatacgcaacaattgcgctaacgattttttgtctaaaatggcatgccgataacgaagggaatcaatcccttgcttgttaacgttaatataagatagctcataattgagcgacttgctggcactgcccatttcctgcaacattgctatcggcgtagattccgccgaagcaatgtttgccatgaacaggctgcccgtcattaaacagacggaaaaccaaagttgcttcattactgctgctgcattcctaaggattgagttccagggacttgaattgcggcttgcgttgaatctgaaggctgctgcaatacatcagtttgtggcaaacgacgttgcaattcaaaatcttgcaattgagtcatcatgttgacgcgccgacgctgctcttgaacctgattctgttgattagtaccaaaagaaccatcagcagggacaccaaaactgactggtgatgctttacccatcattggcaaggtattaaacgccggtgattcaggttgtaaataattttgtgccggttggttatattgttgaacaccaacaatgacagcgagagaaacacaagcggccattcccacctgagtaatctgactggcccatggacggactttttgccagaaaggcattttctgccaaagatgtggctgtggctgagattcaggtatagcaataggaatcaagcgcgctggctcgttcttgagcgcttctgctacacgactagcaatatccagatgtaaaacattgccaacgtctccgcgtagagtgtcacggattaaatggtagctctgccagctttgctgtaacgccttatctttcgataaaatccccagcagctcgctatcgagagtttctccatccatcaaagcggaaagcttttctttctgcatgcctaaataccctttgtgtgtccgcctatcgctgaattagcggctgaactttgttatcaatagcttctctggcacggaagatacgtgaacgaacagtacccaccggacagtccataatggctgctatctcttcatagcttagaccatctagctcccttaatgtgatcgccattcgaagatcttcaggaagtgactctatggttttaaaaactatctgccttaattcttcagacaacattaagttctcagggttcgatatttctttcaatgcacccgcattttcataattttcagcatcattcgcatccacatcactggatggcgggcgccgcccctgagcgactaagtaatttttcgctgtatttacagcaatccgatatagccacgtataaaaagcgctatcaccacgaaatgactccagtgcgcgatacgctttaataaaagattcctgaacaacatcagggacatcgccctgaggcacataccgggatacgaggctcgcaactttatgctggtagcgaatgaccagtaaattgaacgattgttgatcgcctttctggacccgttcaaccagcatctgatccgttaactgctcgctcatccgaggtgaactctcccgaaatctatccccatgctaaaaacagtactgccagccatatcattgtttcctgagcaagcacacgcttggagtttataaaaattgtaaagttccatgttgcccgattttttgtccaaatattattcagacatcttatacccatagctttttcttgagcagataggctaacatgaaaccaactcttcttctgcacacatcatacgatatgcaatcatcatctgaacacattagcgatgtattgatcatcgggagtggcgctgctggcttgtctttagctctccgcctcgcgccacattgtaaagttaccgttctgagcaaagggcctcttaatgagggagccactttttatgctcagggaggtattgccgctgttttcgacgaaactgacagtatcagttcacatgtagatgacaccttaatcgccggtgccgggctttgtgacaaagaagccgttgaatttattgccagcaatgcccgctcttgtgtgcagtggctcattgatcaaggcgttctttttgatacagagaccagtgctaacggtgaagagcgctatcaccttacccgtgaaggtggtcatagccaccgccgtattctgcatacagcggatgctaccggtaaagaagtagaaactaccttagtgggtaaagcaagcaatcaccctaatatttcagtgaaagaacgctgcaatgctgtcgatcttatcacatcaaacaaaattggtttggcgggtaccaaacgcgtagtgggtgcttatgtctggaaccgtgagttagagaaagttgagactttccgcgccaaagccgtggttttggcgacaggcggcgcggctaaagtttatcaatacaccactaacccagatatttcgtctggtgatggtattgccatggcgtggcgtgccgggtgccgggtcgctaatttggaatttaaccaatttcatccaacctgtctcttccacccgcaagcacgtaattttttactgacagaagccttacgtggtgaaggtgcctaccttaaacgccctgatggcagccgtttcatgcttgattttgatccacgcggtgaacttgcgccacgtgatatcgttgcccgagccatcgaccatgaaatgaagcgcctcggtgctgattgcatgtatctggatatcagccataaacctactgatttcgtgatgcaacatttcccaatgatctatgaaaaactgctgtcattgggtatcgatctaaccaaagaagctattccgattgtccccgcagctcattacacctgtggtggcgtaatggttgatcaacatgggcgtaccgatttagatgggttatatgcgattggtgaagtgagctacaccggcttacacggtgccaaccgcatggcctccaattccctgctcgaatgcctggtctatggctggtcagcagcagaagacattctgacacggctgccgacggccaaactggccaagcatctgccagattgggatgaaagccgcgttgataattctgacgaacgggttgtcattcagcataactggcatgagttgcgtttatttatgtgggattacgtcggcattgtccgtaccacaaaacgcttagagcgggctttacggcgcattaacacgttgcagcaagagattgatgaatattatgccaatttccgtatctccaataacctgctggagttacggaatctggtacaagtcgcggagttaatcgtgcgctgtgcgatggaacgtaaagagagccgtgggttgcactatacgcttgattaccctgatcaaatagaaaacccacagccaaccattctgcatccataacacattctgaatccataagattgagggcgtctctacgacgcccgcagactgctgacaaaccccgatgacgcgatcttgaacggtgaggataggcagaggagtaaagcgtccgcgccaaggatggcgcggctcgagcctacatagatgtatttacggcgtctttacgatctgcctgttctctccgtcgcgggcactttgtcaataacctcagggcgtctctacgacgcccgattcttatttcacgctaattattttatttaaaattaattactttatttaaaattaatagtttagatagaaatcactgatgagctggcaaaactcaggtgagtaaacaccttcagactgacgcagagctaaatgttgatacaccgtctcacccgcttgtcttgaaagtgtcagtagcattcgatgtaacggtttaccggggcgatccctgatatcaacctggcaccggacaaaccagccctgttgcccagcaaggcgggcaaattcaattcctaactcatggggtaaaaccacacaaaacatcccgtcctctgtgataagcttctccgcacagttcagtagagcatcatgcgtgagtgacccggtatagcgcgcggtatcacgggcttcatctcgacaagcaatggccggagcaaagtaaggcgggttactgacaatcaggtcatactgatgaggatgattctcagcaaactgatgaatatcttgctgatggatatgaatgcgttcagcccaaggagataactcaacattactgctcgcctgttgcgcagcggcgggttccagttcaaccccgtcaatctgcacctgtggcaatgaacgttgggcaatcattaaggcgataagcccactgccacagccaatatccaaaactctacgggcgtgtaacaccggcacccaagcccccagcagaacgccgtcagtgcccactttcattgcacagcgatcatgtgccacaaagaattgtttaaaggtgaaaccgccaccacgtaataccggttgtttttttaattgttcgcccacattagtcaccaaaatttatactctaaataattcgaattgcagtaaggcagccagcgagagacaaatcggttcgggtgattgatcgtagcaacgcacatgcagcttgaagtatgacgagtatataaccggcgtagcagaggacaatattatttaggacaatattattaaagggaaaagacatcattccgacttaaacaggtgaagaattcggctaacccgtctataatcggcgccccaagtagaggaagaccatgactgtaaccaatttttccgaactcgatctcgatgaacgtctgattgacgcactgcgcgacaaaggctatgagcgtcctacggctatccaggcttcggcgatcccgccggctatggatgggcgtgacgtattaggttcggctccaacaggtaccggcaaaactgccgcctttttgctgccagccttgcagcatttgctggatttcccccgcaaaaaatccgggccaccgcggatcctgatcctgacgccaacccgtgagttagccatgcaagtggcagaccaagcccgtgaactggcaaagtatactcagttggatatcgccacaataaccggcggcgtggcatatatgaaccatgccgaagtcttcagtgagaatcaggatgttgtcgttgccacgacaggccgcctgctgcaatacatcaaagaagaaaactttgattgtcgtgcggtagagaccctgatcctggatgaagctgaccgtatgctggacatgggttttgcccaagatattgaaaccatctcagccgaaacccgctggcgtaagcaaacactgctgttctctgccactcttgaaggtgaagccatccgcgaatttgcggagcgcattctcaatgagccagtagaacttgaggccgatccatcgcgccgcgaacgcaaaaaaattcagcaatggtactaccgggctgacgacatcaagcataagacagcgttactttgtcatctgctgaaacagcccgatgtctcgaagtccatcatttttgttcgtacccgcgagcgtgtccatgagttagtcagttggctacgtgaggcgggcattaatgcctggttccttgaaggcgaaatggtacaagctaaacgtaccgaagcggtcattcgcttgggtgatggccgggtaaatgtgctggttgccaccgatattgcctcacgcgggttggatattgatgatatcagccatgtattcaactttgatatgccacgcaccgccgatgtttatttacatcgtattggccgtactggccgtgctggccgcaaaggcgtcgccatttccttggttgaagctcatgatcatatcttgttaggcaaaattggccgttatcttaacgaaccactgaaaccacgcgttattgatgagttgcgcccaacgagcaaggcaccaagtgaaaaagcgacgggtaaaccctctaaaaaggttttagcgaagcgtaaagaacaaaaagaatccagcaaagagaaagtaaaggttaaggttcgtcatcgtgatgccaaaaacgttggtaagcggcgtacaccaaaagcaaaacctgataccaagagtgctggttagtgatatgcacgacaacaaagccgctgctcacatagcggttttgttgtcagatatctgctcattaccaataccattttcagactgaaatgacattgcgaatattgcgttacctaaaactgacttttttactctattgctcatcaacttctgcaaaatcgttaccgcgcaaccaatcattcaattcctgatattcttgttgtatatcaatgtgttgaatatccaatggtgtcatcgctaaatactgctggaacgttgcaccctgcttgttacgtaatttcggatcagcgcctgctgttagtaactgtaaggccaaacccggtgcattggtcttacccgctatatgtaatggggtgtcacccatacgatcagcaagattgggatcaacgcccgcggccaatagcaaacccacctgaatctcgcgccctgccataaccgctaaggccaatggaaccgctaaagtcacactgtttcgggtattcggcggctggtgaccctcaagtaaaatgcgcatgtaacatgcatcttgcacactggcggcggtatgccatgccgtgtcgccttgtatccctgattgagaaggatcggcgtgttcttgtattaatgccaccaggctggttggctgttggttaaagatcgcccattgcatcagtgttattagccgatcacctcgctgctgcagcaacgctttattggctaaatgatggatctgttgtctctctccgtgcgcaatcgcatcggcgataggcataaccaatggatcagtaaaagcagtactaatttttgtcattgctcatcccccgaaacccaatagcaacatcaaaatagggcaactggcataacgccgtggacatctcacctttatgttcaaacataccgccgctcccaaggctgttgctcactcattgagctaagtactttctcaatgctatgcgccgatatacggcgttcgagatgtttgtgtggtaaccaatcatccacgccagtcagtttgtcgctattggccaagactattttatggcccaccgcattaggaataagtgaagttagctcctgaataccggtcagtaaatcatacttctcactatagctccgtatcccgccattctctgccgaacgccgcgctttagccgagtccataccaaggcgtttgagtgtattcttggcaacccccgcggcattgaaggtaacggcaaaagtcccagtggctaatgcggcagtagccgccaacccaccgcccaatgaatgcccggtgatcaccagcgcatcaccaaaagccatttttgctgtttttcccagagccaccgcttcattgtattgcacatcctcatagcccaccgcctgtcggatattactcaaccaatcgtgccgatcattagtgcctgcaaaagataagacatactgttgattatcactgtagatccccgcgagaaagcctgaagcgctatcagacaaagccgttgggtcaatacctgctgccagtagcctctcgtcacttaaacggacaaacccgttgagattgccagaggtgggggcataaacatctttagcgagcagtgctaatgaataatccgcttgctgtggtctctgcccacttgatattggtacattggtactgcctgtggtcaccccgtgagtgtatgacgtactgtcatagagaacattgtccgccaacgtgggagttgatcggtgaattgcctctgctattttgggggcctgtgtggtggtcaccgccgtggcgtcttctttctttgccttaaccgatggattaacatcatttattaagcaagagactgaaacaggcgtagtcaaactgacagatgcactcatgccaactccttgttgggggataatctaaatcgttatcccggctcaatgagggtatctatcgacacatcagatgatgctcttaagttaacttactaaatttcaggcatgaaaaaaggggaccgaagtcccctatcactttatgatttaatttcttatgacttaattgctcgtctaagaattacaaactttcagtgaaagtccgggtaatcacatcgcgttgctgttctggtgtcagtgagttgaaacgcactgcataaccggaaacacggatcgtcagttgaggatacttttctggattttttactgcatcttccagcgtatcacggctcagaacgttaacgttcagatgctgaccaccttcaacacgtacagttggttgcacttccagtggcacttcgcgatattcgatctcgcccaactcactggttggaactatctgatcttcagcatagccagatttcgcgcaaacacagcgcagttccgctttttcatcatccaacagccaaaaagagttcagcaaggcttcattgttagctttagtaatttgaataccagtaatcatttggtgcctccgtagtacggctataaattccaagggaagataattatcttggttatttggtaaaaccaatgttgtcttattgttctatataccagtccagcccctaccattctttgattcaaatcaattttttcaccacatcatcaatatcgacactggcaaatttatgttttatatcaattttgtcagaaacgcgaccagcaattatttttgtaaactttcaacattttttatatataaaggtcaaaaaaacaacatcatgtcacagacatcggtttaacagtttcactcatcggtttgaaccggtaagctagcgcacatcaatactttgcagaaaccaaggagagtgtttatgtccccctcccttacttggcacgatgtaatcggccaagaaaaagaacaaccgtattttaaagatacgctggcctatgtggcagcagaacgccgtgcgggtaagaccatctatccaccacaaaaagatatatttaacgcttttcgcctgaccgaactggatcaagtaaaagtcgtcattctggggcaagatccgtatcacggccccaaccaggctcatggattatcattttcggttctacctggtgttcctgcccccccttcattggggaatatatacaaggaactggtcactgatattccaggattccagcgccctaaccacggttttttacaaagctgggccgagcaaggcgttttattacttaatacggtcctgacggtagaagcgggcaaagcccactctcatgctaaccttggttgggaaacctttacggataaagtgattgctgcgttgaatgaacaccgagaaggtgtgatttttatgttgtggggatcacatgctcagaaaaaaggccgcattattaatactgagcgccattatattttgaaagcaccccatccatcacccttgtcagcacaccgtggttttctgggctgtaagcacttttcgcaagctaatcaattactgcaacaacaaaatcagcagcctattgattggcaacctaagctgccagcggtggagtaaatcaccgttcagatcacaaccccacctcttaagccaggacgttgtctgcaacctcacgccaccttcggctgccgtgaggttattggaagatcagtgaactgctccccccgtgatatgcaaatcatgctcaatctgcaatgcgatagagatagccaattctaacgcgaccaacactgattgtgccgacatactgggcgcaccggggtgatcaactgcctgttctggcaaataagggatatgaataaaaccgcccttgacctcattattaaactgatttaaccgatgcaataaaccatacataacatggttacacacataggtacccgcagtttgagaaactgatgccggtatccccgcttctcgtatcccctgaaccatggctttgatcggtaggcgggtgaaatatgccgcaggtccctcttgaataataggctgatcaacgggctgattacccaaattgtctgggatacgcgcgtcatcaacgttaatcgccacccgttcaatggtaatgtccgcacggcctcccgcctgaccgatagcaagtaccaatacgggctggacatcatctatcgcggtgttcagggcggtcagtgcctcaccgaatgcgcagggtagctggcgcgccacaattctgacgccacccatcattaaatcattcatttgtttgaccacttcccaggaaggattgatccgctcccccccaaaaggttcgaacccggtaattaatacacgtctcatcgcctctccttagagaaacatcaggaaatacagtaaaaatacgttaacaatcaacagagctaccccggttgggatttgcgctttgatgaccgcatttttgtccggcaattccaataatgcggccggaacaatattataattggccgccatcggtgtcatcaatatcccacaatagccagagaacatgccgatggccgccatcactgccgggtttcccccgtgttgtaacactaaaataggaataccaataccggcagtcactatcgggaaagcggcgaacgcattacccatgatcatggttaacagcgccatgccaatagcatagaccgcaacagcaataaagcgctggtcgacggccagatattcttgcgtaagatgagcaatggccgtcccgacacccgcgccagtaaatagtaaccccagtgtcgccagaatttgcggcagaataaatgcccagccgatagaatccagcaagcggcgcgcttcctgtaccggttgcgccgccgtctcacgggtcatcgccacggcaaggaccaagccaagaacacaaccgaccgtcattgaaaatagcgtcactagcgtggagtggttacccggaccaaacatcccttgttgcagagccggtatgttattgaacaacagcacaccgataaccgtaaccaatgggatagctaatgctggaataaatagccgattacctaaacgttttgcgctaacttcacgctcttgcggcgtccgttggtggtaactgcccagctttacaccaccaaacccggcaatcaatgccatgaccaccacgaccagacccacaataatattcaggacgcgtttctcatctgggccttcgcccgccagcgcattcgccagccgataagtccaatcgccaaccagaaaaatcaagccatacaacccccaaaacaaaccggtggttaagcgccttggattggctttatcacgaaatgacatcaccgcgacaatcaatagcaccactccggccagccaatataagtattgttgttggaaaatcatttagcctctccctgagctgccagggcagactgattcagcgccgttaattccgcagcaagttgtttatctaaccgctgtaaacggtaggcatggatcaggaaagcacaaatcgcggttgggatcccccacagcgcgatatgcaatggttccgtctgaatgccacccgactccaacataaagttgtgcataaagataatcgccccgaaagcgacaaagatatcctcgccaaagaacaaccccacgttatcggttgccgctgacatggcacgcaggcggtagcgaactttctccggcaattcgccatagcggttctctgccgccccctcagccattggtgccaataagggccgaaccatctgggggtgaccaccaaggctggttaaccccatagcagccgtcacttcacgcacaaagaggtaaacaattaataagcggcctgatgtcgcacttttaatttgcataatccatgcctgcgcccgctctttcaaaccatgacgttcaagcaaaccaatgaccgccaagggcagtaacagaatcaagggcagattacgggtgttaagaaatccctgacccagattttctaaaatagtggctattggcatcaacgcggccagaccagtaataatcccggcggtgatcaccactaataccgcgtttatccgcaataaaaatccaattacaatcgccgcaataccgatcagcggccaaagatttaccgtttgttccaagagaattctcccgccctgaagtctatttcaataatgtaaaacgtatttaagtgataaatatattctgcccgaggtaggcgctggttattgcgctatcacgctgatgccttcctgctgaaaacggtctcgtaaacaacgcgcaaacgctaatgcctgtacgccatcgccatgaacacataccgtatcagcttgtacctgtacccaactgccatcgcaggcctgaacctgatgctgttgcaccatagccagagtttgtgacagcgctaactcgtcactttctattagagcatctggctgactgcgaggaactaacgtgccatcgggttgatagtggcgatcagcaaacacttcctgccgggtgactaaccccacacgggtaccggcgcggatcaactcactcccggctaacccgaccagacgtaatgacggatccacagccttaaccgcctgagcaatggcatccgccaataacggatcgaccgccgcttggttatacaacatgccatggggttttacgtgctgcataacccccccttcaacctgcacgatggcggcaagcgcgcccaattgataaaccacttgagcatagacggtctcaggtggtagctgcatagcagtgcgaccaaagttttcccgatccgggaagctcggatgtgcaccaatagccacaccatactccaacgcccagcgtaccgattgacgcatagtttgcgcatcacctgcatgaaaaccgcaggctatgttggccgaactgaccaattgcagcagcgcctgatcattggcgcagccctcacccaaatcagcatttaaatcaattttcactgggcctccggggtaacaaaacccttctctaaaccccattcaatttgctgtaggaaatgctgttgctctcttttggcgcgtagtgcttcttccacagtacatggtacaaaatgtatcggctcacccagccgaatttgcgccaagtggtagagatccgcctcaatcacgcaagcaatccgtgggtagccgccggtcgtttgtgcatcagccatcaatacaatcggctggccgttatggggaacctgcaccacaccgggcaatagaccatgagatagcatttcacgcgtggtgttacgcgttaattcgcggccactcaggcggtatcccatgcggttactttgcggactgagctgccaggcttctcgccaaaaagcattccgcgcaacctcatcgaattcgtggtattccggtcccggcacggcacggacacggttaccgaataatagctgtttaacgccaacagattcactgggcaaacgggtgggtttacccaatggcaggcggtcgccttctttaatcaaccgcccctgatgaccaccaaacccggctttcaaatcggtgctgcgtgaacccagtatttctggcacgataataccgccagaaagagccagataactgcgcataccgcggtgcggcacactgagttttaactgttgtccggccttaaccggatagcaccagccggtccagagccgctgttcatcaagtctggcatcgcaaccggcaccggttaaggcaatccaacccgattgggtaaattctgctgtaaactgcccaagggtgatttctaacccagcggcatcgctagcgttacccaccagcatattcgccatactcagcgcgggtaaatctaacgctcccccttggctgatccccaagcggcgaaaaccgccacggccagcatcttgaaccgtggtataaatacctgcgcggatgatattcaacatacgccctcctttagcggcagaaagcgcacattatccccaggtcgcaataaggtcggtggcatcgccactggattaaacaatgccagtgaggtgcgaccaattaactgccaccctcccggtgttgccaagggataaattcccgtttggctgccaccaatcccgaccgaacccggtgcaacgactaaacgtggatctgcacgccgtggtgtagccagttgctctggcatccctcccagataagagaaccccggttgaaagcctaaaaaatagacgatataacgggcgcccgcgtggcactcaaccacctgacgttcactcatccccgtatgacgggcaacgtcagccagatcgggaccgacttcaccgccatacattaccgggatggtgatatcccgcgattcgggtatcaatgactcgctctcttcccaccaacgttgtaaccgctcaatcgcatctaaggcagtattgtgtggatcggccaacagtagagttaaattattcatgccagggatcacctcaaggatatcggcatgatgaattaggcgatcagctaagccccaaatccgttgctggctggctaatgttaccggtggttctaactccaacaccaccgcactctctcccagtaaatagcatcgtgctcgttgcaccccgtccccctgattaatttatggttcttgtttttagatacccaacgtcattggcgcgacagcaaaataaaatactcgaatcccgataaacttatctcaacaaggattcagacattcaccgccgctagccacgccgtcatgcccagcaagcagggtataactcaataattatcgtcaataagcacatatttatgctttagcccttggctgctgtcaatagaactaaactaaccaataaatactatcaatcactaaataggggggcaagcgtgaaattaatcaccatgaatggcacgttttgaggtttttttcatcaagatggcgggaagtcagcaatacttttcttgtttaaaatcaacgactggagaggaggtatgtatgaaaaatgtctatttatcatccaaaaacaatcaaatgactgttttaagcagcattaataggacaaaggcctgtttattttatgggtataaagcgaggagtggcaaaaaacttggggtaactcgccaacgaatggcagatcagccaggaacataaacgccgcttaatcgcccggcagcgccatgtaagacggagacacgccgatgctaaacatcggcgaaaatagccctatcccctaactcaggcagggttaggaatatcaataaaggtaacatctaattgatgttgttcagccagccattcacccagcgctttaatgccataacgttcagtcgcatgatgccctgccgcataaaaattcactttcatctcacgggctatatgaattgtttgctcagaaacttcacccgttataaatgcatcgacaccgaactcagccgcttgttggatatacccctgcccaccgcccgtacaccaggcaatacggcgtacctctgcgggcgcccgatcaccacaatgtaatacactgcgccccaactgtttttccagacgctcacgtaaagcgacggcattcagcggtgtggtgaactcaccgtagggcaacaaagattcgatttcacccaagacctgtatctccagcaatttagccaattgggcattattgccaagttcgggatgtgcatccagcggtaagtggtaaccgtacagattgatatcgtgggtcaacagtgtttttaagcggttgcgtttcatcccccgcaccactaccggttcatttttccagaaatagccatgatggactaaaatagcatcggcctgatgcgcaactgccgcatccagcaacgcctgactggcggtcacaccagtaacaacccgctggatatcccgccgcccctcaacttgcaaaccattgggggcataatcttgaaaagccccgatattcagttggttattgagtacagtttccagttcaacgttacgcatcatttcaatctcatcaggtcagtgtcaattaatcagtataaatacagcgcggggactatttttgtcacctagctatttttgtcacctagctatttttgtcacctagctatttttgtcacctagctatttttgtcacctagctattttcatcctataaaagaaaagccaaccataagtcactggaatttctggctatcaccttgttccatcaggataaattcgattcccatatcattgccttgttgcaactcagagagaattaatttacgcacatcctgcccctgctggaatgagggttttatgtggctaatcaccaccggtaatccttttagtggctggccttccccactgtattgctccagttttttcaattctttcaacaaccacgttggtgtcatgtggccaaacaacttattgtctgccacatcattaggatacgagacctcaataatcatccctttcagttgttgttgtgtaaccttctccgccagtttgcgccagaccgtatccagatttttggatttttcgacatcatccgggccggtatcaccgaaataggcaaagaactcattattactactgataagcagcatggatgagggcgatttatcatgactcagtggatacatttcccccgttaagcgggtcaaccccaagctcaaagactgagccgggcgcaccacttgcatacggtaagtccctaaacgagccccactgccgctgtcggtaaaattgggccaaacgcgccagttaaaatagtagtttctcagcacatcaatggtatcagccgaagcataaatggttttcttgctgtcatccggtgaaccgataatcaggccagagacatgatctaaatgcgcatggctaataaaataactgttaatgctctggcgaaaaatatagccctgccgggttagcggagcggccatggcatcggtgatcgctgcaaaatggcctttctccaaggcacgagcgatccctggcaacacggaaccggcatccagccccaaatacagcggctggctatcattgcgaatcagataagaggtcagattaccatcactgacacccccatcaacgccaagcgccacgacctcaaaagccgcagtggacagtgaactgaagagactgaaagataaaatcacgcccgtctttagcagaccactctttatcttatctgatgcagatttaatcgagagatatttcaataacatgaaggctccttgcgattagggatccttgtgctatcccgcttagcggcttcaaatgccgcgagtgtagccaatctggcttgcttgtgatcaaccaacgggacaggataatccagatgctgctgttgccgttctgcccagcgccatggctgatgaatatcactgtctggtaccgcagccagctccggtaaccaacgacgaataaataccccgtccttatcaaaccgctcgccctgcgtggtgggattaaaaatacgaaaatacggtgcggcatcggtaccggttgatgcggcccattgccagccgccattattcgcggctaagtccccatccaccagttgtgacataaaataacgctcaccttgccgccagtcgatcagcaggtctttaaccaaaaaactggcgctgatcatgcgaaggcgattatgcatccagccagtttcattcatttgacgcatcgcggcatcaacgatgggataaccggtttgcccctgctgccaggctttcaattgcgattcagatcggttccatactaacccatcagtccagccaataaagggatgatgttggcataaacggggataggccactaataaatggcgataaaactcacgccagattagctcattaagccaagtgaatgcaccactgtctgcgttctctaacatttctggggattcagcccacaggcgattaaaacattgacgcggtgaaaggacccccaacaccaaataaggggataagcaactggtaccgggcaccgccggcaaatcgcggtattgccggtaatcctgtacctgttcacgacaaaaacggcgtaaacgctgtaaggcagcgtcttcccctgcaggaaataactggctatcaacggactgctgtgggtaatcaaaaggcaacggtgagagcagaacgggaggagcatggcgggctttcggggccggaacacagtggttatcactcatcaataaacgctgaataaacgcacggcgaaaaggcgtaaacactttatacatttcattattaccggtcagaaccgtccccggcgcgagcaatacactgtcatgaaaagactggcaggtgatagctcgcccactgagttgcaccgccagcgcatcgtcacgtaaccgctcgttcagttcatactgttgagaataaaacaggctatcgacctgctgttgctgacaaaaatcgaccagccaagtatttgacgcctgaaaatcatcacattggtgataatgcagcggtatccctcgagccgcgagagctgcctgcaaatgttgtaaattttgtcgcaggaaagccgcctgcctgggtgccataccatgtgcagcccattgcacgggtgtggcaataaacacggcaattacgctcgcttgtgggtcctgacaggccgcatgaagcgccaaattatcggtgacccgtaaatcattgcggaaccagaccagatgcgtagacatgccttatccttatttactcatgggctcaacgtcttcagggttaaatttcattcaaccaccagacaacggcctgcttggtacttaatcctgtgcgtaacttaatacttaatcctgtacataactgggtacttaatcttgtaaataaaaagaaaaatagcgctgctgagccagataatcattggggaactcagccagatactcggtgatttgtgcaatgggagcctgcagaggctgattgcctaaacggtattgctcaataagctgtgccaatgcctgacgctgagctgaactgagataagggcgaaaatagccctgtacgtgcattaacacattggtgtgattggctaccgtgggcaagtgagaaagtaaatgcagtaagcgccgacgatattcagccgtaaattcgctcaaggatgaccagttgctgattgccgcaataaaaggaccgatttcacggtattcaggctgagaatgcgccagtaagaccaacttatagcgacgatgaaaatccatcaacccgccacgggtcaccccagcgcgacacaaaacatcaagttcctcacacgcatagcgatattctttactgtgaactgcccgatcggttcccggcatgacatcctccctctgcggttactttgatcatcagattcttgatcatcaggtacttggtcatcaggtacttggtcatcagatactttggtcatcagaatcgttttcatcataacagtagttgccaagaatctgcggtattggttgacgggtttactgatggggaggttatacagcataaaaaaacagcgccagcccggaatcggctgaaaacccactgtcgatattatctaccacagccacagccacagccacagccacagccacagccacagccacagccacagccacagccacagccacagccaaaaaataccgctgtttaaagcgcattaaaaaagcccgtgggcatgatactcacgggccagctattttttgtaaatttcttaccaatgtgaattcagccgatatatgactcagtaaaagtcacgacctgccttttctgattgggtcagccaaaccggtttatcactggtttttatccagatacggtgcaaatagctgtaaagacgggcacggtcacggcggaaaaacatgacgggcagcgccaatacaccgactaaaacgactgcgatacgacgcaggagaaccagatgcaatgggtatgcgttgtacatggacataacgatcctcccgataaaatgcgtgaatgtggaaactggacaaaattttaccgtattggctgaaattttaccactcatccgaccaccattttacctgaaaagtagaaataaactgccagtttcgtaattttgttacgtaaaagttgatttaaatgaatcattgttatgctttggttgcgtattatttgccaattagcaaaccaaatacattcacccggtgaaagtaagtttcacaaaccaagcttgacatcaatacttcaactgatcaaattacactcaattaatgagcattttttgaccgtttttatattttttttacgctataccctgtttttttatcaagaacttttcttacgacttcctaagctgttgttattaaaaaatactacctcaggaggtatatcgtgaatttcagcatcgtttgtggtgcgttgctggtcctgctgctgttgggctatttggtttatgccttatttaacgcggaggacttttaaatggtagcgtcaggatttctgcttattgccagcttcatgctggtgttgttcgtgttgtcccgtccgttgggtgggtttttagcacgtttgattgaaggtgagcccttctctgcgctgcaaaaagtcgaggccggtttatggcgttgcagtggggtgaaaaatgcagagatgaacggctggcaatatgctctcgctattctctgctttaatctactggggatcgtcttgctgtttgtgctgctcatgacccaagggtcattaccgctgaaccccgaacatctgccggggatgtcatggcatctggcactcaataccgcggtcagttttgtgactaacaccaattggcaagcgtacagcggtgagaacaccctcagttatctgagccaaatggcggggctaaccgtacagaatttcctttccgctgccactggtattgccgtcgcctttgcactgatccgtgcctttgcacgccattcagccaccacactgggcaatgcttgggtcgatctggtccgcatcacgctgtatgtcttactccctatcgccttgatcatcgcccttatttttgtcagtcagggcgtattgcaaaatctggatggctacctgcatatcaccacactggaaggcgtgcaacagaccttacccatgggccccgtagcgtcgcaggaagccataaaagtgctgggaaccaatggcggcggtttctttggtgcaaactcagcccatccgtttgaaaacccgactgcattcagtaattttgtccaaatgttggccatttttctgatcccttgcgcactctgttttgccttcggtcaggtcgtcggcgataaccgtcaggggcacgctcttatctgggccatgtcactgatttttatcgttgctgtggtggtggtgatgtacgccgaactggcgggaaacccgcatttatccccgttaggggctgacagcaatagcaatatggaaggtaaagagtcgcgcttcggtattctcgccaccagcctgtatgccgtagtaaccaccgccgcctcctgtggtgcggttaacgcgatgcatgactccttcactgcattgggtggcatgatccccctgtggttgatgcagattggtgaggtggtgtttggcggcgttggttccggtttatacggcatgctgctgttcgtgctgctgactgtctttattgccggtctgatgattggccgcacacctgaatatctgggtaagaaaatcgacgtatttgatatgaaaatgaccgcactggccattttggtgacccccactatcgtgctgttagggacggcgttagcactctgcacagaggctggacgggcggggatcctcaaccccggtgcgcacggttttagtgaggtgctgtacgccctctcctcggcggccaataacaacggcagcgcttttgcgggtctgagtgtcaacaccccgttttataacctgctgctggccgccgccatgtttatcgggcgctttggcgtcattctgccggtgctggccattgccagttcactggtggcgaagaaacggcaacctgcgggtaacggcaccctgccaacgggtgggccgttgtttatcggtttactgatcggaaccgtcttattagtgggcgcattgacctttatcccagcattggccctggggccggtcgctgaacatctacaagtctggttagcacattgattatccggtttataggtgagcaaaaaagggatcatcaagagatgactcgtcaataccgactgaatatccatttgtcgcaaagagagaataacgatgactcacaaacaacgcgcgatttttgagcctgcactggttcgcactgcgcttctcgatgcagtgaaaaagttggatccgcgcgtccagtggcgcaatcccgtcatgttcgtggtgtatttgggcagttggctgaccaccctgatctggctggccatattaagtgggcacaccacgggcagcgccatgtttaccggcagtatcgctttatggctatggtttaccgtgctgtttgccaacatggccgaagccttggccgaggggcgtagcaaagcgcaggccgccagtctacgcggggtgaaaaaaaccagttgggctaaaaaactgtccgaggcccgtgttgatgcaccacaagaaaaagtctctgccgacagtttgcgcaaaggcgacctggtgttgatcgaagccggtgacacggtgccgtgtgacggcgaagtgctggaaggcggtgcgtcggtcgatgaaagtgccattactggcgaatctgcgcccgttatccgtgaatccggtggcgacttctcgtcagttaccggcggtaccagagtattgtccgattggctggtggttgaatgtcgcgttaaccccggcgagaccttccttgatcggatgattgccatggtcgagggcgcaaaacggcgcaaaactcccaacgaagtggcgctgaccatattgttggtggcactgactatcgtctttttactggcaacagcaaccctgtatccgttctctgttttcagcgtggaggccagccaagccggtagcccggtgaccatcaccgtgctagtcgctttattggtttgcctgatcccaaccacaatcggcgggttgttgtcagccatcggggtggccgggatgagccgcatgttgggggctaacgtgatcgccacgagtggccgggcggtggaagctgccggtgatgtcgatgtgctgctgctggataaaaccggcaccattaccctcggtaaccgccaggcctccgagtttttacccgctcccggtgtcaccgagcaacaactggcggatgccgctcagctttcctcgctggcagatgaaacgccagaagggcgcagtatcgtcgtgctggctaaacaacgttttaatttacgtgaacgtgatctgcatagcctgaatgccacctttattcccttctcagcacaaacgcggatgagcggtgtcaatgtacaggagcggatgatccgcaaaggcgcggtagacgctatccgccgccatgtggaatccaatcagggccacttcccacccgccgtggatgatttggtcgccagtgtcgcccggaccggcggtaccccattggtggttgccgagggatcacgcgtactgggcgtggtggcgttaaaagatatcgtgaaagggggcattaaagaacggtttgccgaactgcgcaaaatgggcattaaaactgtgatgatcaccggtgacaatcgtctaaccgcagcggcaattgccgctgaagctggcgtagatgattttctggccgaagcgacacccgaggccaagctggcactgattcgccaatatcaagccgaagggcggctggtggcgatgaccggcgatggcaccaacgatgcccccgcactggcacaggctgatgtcgcggtagcgatgaactccggcacacaggcggccaaagaggccggtaacatggtggatctagactcgaacccaaccaagttgatcgaagtggtgcatatcggtaagcaaatgctgatgacccgtggttccctgaccaccttcagtatcgccaacgacgtggcaaaatatttcgccatcattccggctgcctttgccgccacgtatccgcaactcaatgcgttgaacatcatgcagttgcattcaccgtcttccgctattttgtcggcggtcatttttaatgcattggtcatcgtgtttctgatcccgctggccctaaaaggtgtcagttataaagcgatgagtgcggccgccctcttacgccgtaatctgtggatttacggtttgggtggcttactggtgccgtttgtcggtatcaagttgatcgacctgctgttaaccgccctgaatatgggctagcgactcagccgctgtaatcatgagcacagaagggttagcgcaataattatcataacggcatttattacgacagccatggccaaggcgacaataaaccgtttaaccacagccatcgcaccctgatgcggtggccggttttaagacacaaattgaggcaatatttatgtcatcgacaacatctccattatcatctgcatcaccgacatcgggcatgtcctacctacggccagcgctggttttactgatattactgacactgatcaccgggatagcttatcctctgctcaccaccgggttagcgcacttgatgttttcacagcaagccagtggttcactggcgcgactgggcgataacgttattggctccactttaattggtcaaaactttactcaaccgggttattttactggccgcccatcagtcaccgcagataggccttataatccaatggcttcgggtggcagtaatttggcaagcagcaacccggcactgggccaggctatcggcgaacgagttaaattgcagcgtcaggctaatcccacccaattgggtccagtcccggtggatttagtcaccgcctccggcagtggtctggatccccatatttcactggcagcggcttattatcaggcaccgcgtatcgccagtatccgtcagatgccgctgtctgatgtccagcaattgattgataacagtatgcaaaaagcgatacccagtttctttggcgagcccgtcgtcaatgtgctgaatttaaatatggcgctggatagccacagccacgtaaaagtccccgccaacccggcaaaaccgtaaggaacgatcatggtggatgcagaaccaacccgtccgaaccccgatagcctgttagccgtggcaaatgaaaaacctcgtggccggttaaaagtcttttttggggcctgcgccggggtaggtaaaacctacgccatgctgcaagaggcgcaacgcttgcgcgctcaagggttagatgtgctggtcggggtggtggaaacgcacgggcgcagtgaaaccgccgccttacttgaagggctaaccgccctccccctgaaacgcatccaccaccgtaaccgccagatacgtgaatttgatttagatgctgcgctggcccgccgtcccgcgctgatcctcatggatgaactggcgcacagtaatgccaatggctcccgccatcccaaacgctggcaagatgtcgaagagctattggatgcaggcattgatgtgctgaccaccgttaatgtgcagcatttagaaagcctgaatgacgtggtcggcggtgtgaccggtattcgggtgcgtgaaaccgtgcccgaccatatgttcgacgaagccagcgaagtggttttagtcgatttaccccccgatgatctgcgccaacgcctcaatgaaggcaaagtgtatatccccggccaagctgagcgcgccatcgaacattttttccgtaaagggaatttaatcgccctacgtgagttggcgctacgccgtacggccgatcgggttgatgatcaaatgcgcgccttccgcgatacccaaggacgtgaacgggtttggcatactcgcgatgccattttgctgtgtatcggccaccacgcgggtaatgaaaagttagtgcgtaccgccgcccggttggccgcccgcttaggctgcatctggcatgcagtctatgttgaaaccccccggttgcacggcctgccagaggctaaacggcgcgctatcctgcgcacccttaaactggcacaagagttaggcgcggaaaccgctaccttatcggaccccagtgaagaacaggcggtattgcgctacgcccgtgaacacaatctggggaaaatcattattggccgccgcaccgagcaacattggaaactgcgaggcagttttgccgatcgcttaggtaagctggggccagatctggatttggtgattattgcactggatgccgatccgccaaccaatgtcgctaaagaaccagactcgcgccccttcaccgaaaaatggcgtatgcagctacggggatgtgtcgccgctatcgccctgtgtgcgctgatcaccgtgctatcgttgtggttgatcccccgtttcgatcaagccaatctggtgatggtttacttgttgggcgtggtgattattgccctgttttatggccgctggccttcagtgctggcggcggtgattaatgtcgccagcttcgatctgttttttgtccaaccgcactggtcattagccgttaccgatgtgcaatatttgctgactttcggtgtgatgctgattgtcggtatcgtggtggggaatctgaccgctggggtgcgctatcaggctaaaattgcccgttatcgggaacaacgggccagacatctgtatgaaatgtctcgcagtttaagccgcgctctgacaccggaggatattgccaaaaccagccgccattttctttccagcagttttcaggccaaaaccagcctgctactgccacaggaagagggccatttacagccaataatgcccgatgacgggggcatcctgtccgttgatgatgccattgcccattggagttttaatcagggtgcccctgcaggagcgggcaccgataccctgccgggcgtgccctaccaactgctgccgttgacagcggctcaacagacctacggcgtgttggcgattgaacccgctaacttacgccaactgatggtgccggagcagcaacggctgttgcaaacatttaccagcctgattgccaatgcattggaaaggctacatctggcccgcagtgctgaactggcaaaactggatgctgaacgggagcaattgcgtaattcgctgctggcggcattgtcccatgatttgcgtaccccgctcaccgtgttattcggtcaggcagaaattctgacgctggatctggccgccgaaggttcgcgccatgccccgcaggctaaccaaatccgccagcaggtcttgagcaccacccggttggtgaacaatctgctggatatggcgcgtattcagtctggtggttttaatctacgtaaagagtggcaatcgctggaagagattattggcagcgccctgtatatgctggaaaccaccttaagtcagcatcagatacgcgttgaattgccggatgaaatggtgttgatcaattgcgacgcaagcttgctggagcgggtctttatcaacctcctggaaaatgcccataaatatgcaggtcacgccgccttgttgggtatccgggcggaagtgcaaggcgagtggttaaatgtggacgtgtgggataatggccccggagtcaccatcggtcaggaaaatcttatttttgataagttttcccgcgggaataaagagtctgccattccgggtgttggcttgggtttagccatttgtcgtgccattattgatgtccacggcgggcgtatctgggtggagaagcgtcaagagggcggagccagcttccgttttgttttgccactggaaaaagtgccggaaattgatgccgacaatattgataccaacaatattgatactgaaaataatgatatatcctgaggtttataacaaaatgcccgcggcagacagaataacgaaggcagccaacgcaccagccgcttgaagcatgacaaacattactttaaataattcgagttgcgggaaggcggcaacggagagaatccccgggagcttacatcagtaagtgaccggggtgagcgaaggcagccaacgcatcagccgcttgaaacatgacgaacattactctaaataattcgagttgcgggaaggcggcaatggagagaatccccgggagcttacatcagtaagtgaccgagatgagcgaaggcagcgaaggcagccaacgcatcagcagcttgaaacatgacaaacattactctaaataattcgagttgcgggaaggcggcaacggagagaatccccgggagcttacatcagtaagtgaccggggtgagcgaaggcagccaacgcatcagcagcttgaagtatgacgagtaagtatgacgagcaaaaggagaacaaattatatccccgacacacatcctcattgtagaagacgaaaaagagatccggcgctttgtgcgtattgcgctggagagtgagggctggcgagtatttgagagtgagacgttacaacggggtcttattgaagccggtacccgtaagcctgatttgatcattctggatttggggctgccggatggtgatggcctgaactatattcaagatctgcgccagtggagcgctatcccaatcattgtgctatctgcccgtaacaatgaagaagataaagttgccgcactggatgcgggagctgatgactatttgagtaagccttttggtatcagcgaattactggctcgggtacgtgtggccttacgtcgccacagcggagccagtcaggaaagcccgttagtgaattttgctgatatcagcgtcgatttgatcaaccgccaagtcacccgtgcgggtgaaaatcttcacctgacgcccatcgaatttcgtctgcttacggcactgctggctaatgccggtaaggtcattactcagcgccagctattgaatcaggtttggggaccgaattatgtcgagcacagtcattacctgcgcatttacatggggcatttacgccagaaattagaagccgatcccacccgtcctaaacacctgttaacggaaaccggtgttggctatcgttttattccctaaggttttttcaatgccagactgctgattagggctaggaaaatgaaactcagcggcgtagcatcctatttttgaatgctaataggtcttatttgttatgagcacttggttaatttacgccctgctgtctgccttgagtgcctcgctggtggcaatcttcggtaaaatcggtctgcagcatttagatgctaataccgccaccgctgtacgggcggtggtgatggcgctatttttagtcggcgtggtcgtggttcaggggaaatttaatctggtgggtaccgtgctggccgataaaaaagccctgttgtttatcgtactgagtggcgttgcgggggctttatcctggctgttctactttatggccattaaaaatggcacggtttcgcaagtggctcccattgataaactcagtgtggtgtttgccgtgctcttggcgtttattctgtttggcgaaaaaatctcattagttgccgggctaggcgtagcactgattactgccggcgcattgatggtggctctggggtaataccctccccaaaaacataattaattaaaccaccgcccattgatattattaaattaatcttagatgaccgcctgagcggtcatttttaattgcgccaaatcatgcaagatagtttatatttttagcattaagcctcttcagataattccttgatgatatttttcttggattgctcaacaagagataaaaattcttgtagttcaaaatcccatattccaccattaggacaagagaaaatttctatgcgagggccaatgcctggttcatttgatatctcagcaacttgatcagtcccacagtagatttcataaacaacattctctctatcctgcacacttgctatttgagccgttaattttgtatttatcatcttggaggctccaaaaaaccgataagtttatcactagcatcatcacgtaatccgcgaccaagccgcattagcactgatgatacgttcgtactcttcgggtgccagattatcttttgagagccagtacaggtcgtttccaggcagacttaaacttatgccaaatccttatggcgttaacattcaaaataaaaccatacattaaatatggaattggcatccaataaaataaccctagacaggagtgcagtgacaatattgagtcaaagataacggattaagaaaaacacataaaaaatccggcaacagagcctgtgccggattgatcgagtgccaagattacagcgttggtctttaaggacaggaatatacccgcttatttcgcctcagccagcacttcgctgacaatctttacggcttcttgttctattttttcgcgatgctccgcgccaaggaaactttcacagtaaattttgtacgcttcttcagtgcctgatgggcgagcggcaaaccagccgttctcagtcatcactttcaagccaccaattgatgcaccattccctggggcattggttaaacgggcagtgatcggatcacccgccagtgtattggctttcaccatttcaggtgacaatctggacaaggcatttttctgcgcctgcgttgccggcgcctgaatacggttataacttggcgcaccaaagcgttgtgctaaatcatcatagtgacgttgtggatccttaccggtcacggccgtaatttctgccgccaacagacacatgataatgccgtctttatcggtcgaccacggcgtgccattaaagcgcaggaaagaagccccggcactctcttcgccaccaaaaccaaaactgccgtcgtgtaaaccatcaacaaaccacttaaagccaacggggacttccaccagcttgcggcccaaatcagccacaacccgatcaatcatcgcactggaaaccaatgttttaccgactgccccccccgccccccattgtgggcgatgctggaacagataattaatagataccgcgagataatgattcggattcatcaacccggctggggtcacaatgccatgacggtcgtaatctggatcattagcaaaagctaaatcaaatttatcgcgcagtgccaacaaaccagccatcgccgactctgaagagcaatccatgcggatcacaccatcgtggtcaagatgcataaatcggaatgtctgatcgatggcattattgaccaacgtcaaatccagcttgtagtactcagcaatgcgctgccagtaggcaataccggagccgccaagcggatccacaccgagcttcagccctgcttgttgaatggcgggaatatcaacgacatccaccaaaccttcaacataagattggagcaaatcctgctcacgcagatgattgctctgccaggctttatccaatgtttggcgcttaacaccctttaaattctggctgagtaactgattagcccgcttttcaatcacggacgtcagattagtatccgctgggccaccattcggcgggttgtacttaatgccgccgtcttccggtgggttgtgggatggcgtaatgacaataccatccgccaacgctttaccctgggcgttatgacaaagaatgacatgggaaatggccggtgttggcgtaaaaccattatcttgctgtacgacaacatcgacaccattcgccgtcaacacttccagcaccgaaataaaggcgggctcggatagcgcatgggtatctttacccacatagcatgggccgctgataccgtgttgatgacgaacttcagctatcgcctgcgcgatagcaagaatatgagcttcattaaaactgtggcgcactgaactaccacggtggccggaagtaccaaatttaacggcatgagcggggtcttcagggtctggctgcaatacataatattgcgatgtcaactgagctacgttaattaaatcgctttgctgagcaggttgcccagcccgagggtgattcgccacagtcactactcctatacacgtcctcagcaagggcgttgccattggctgagaaagaggatggtttcaatgaaatcagatagttccgcacactttgtcagtcaactccggcgggaactgcattgccagcatgatgtgctgtaccatactgcgcttacgctcagtattggtattggtgataacccagaatggcgtacctggcacatgcttgggtttagtatgtgtcccgtgttgcagcaatgtctgttgatcaccggcaaagtagactcgggtacgaccatgcaaagattcagttgcctcagtaaacgcctgcgcatctaaggtatataaggtcgataataccaacataaagcggttaaccgccctactctgttctgcatattcatcggacagcagcaactcacggacggcacgaacccgatcccgtggggctggctgggcagtcactttcacagcagcaccgctgacaggcaggtcagttaccggctgaccggcagtaaacttcagcatacgccgtaagatatctgacgcgctctcacctatgtgttgcgtatggctggcgatatagcgataaagttcttcgtcgagttcaatagttttcatctttatccaaaacaataatgcagttgatttttatagtgtttttatagcaatcaaagaaaagtttaattttgacctacattttttcaaccatctggttttacggtatttcattactttcggttagattaacagactctagagggtcatccaactttccccgccatgactttgtattgtcaccacattgatgcccgccaatccccggcctccatatcatctcaatgaccgccttgggcttctctatgagcgagccgatatcactgagtggcagacaaataaacgcgaggaggaacgagaacgtcacaatcacgcaacgtgacaccaacacattgattgataatcactattatttagagaaaggaagatgtagcaccgttagtgaagtgggatctgtttttttcaagaaaaacgctgaaggtgattactttttgtctttcgatcaataatactcaatggctcaatatgataactaaatgagaatgaagggataaaacgtggtgaaacagtttacatcaggactcataatttcaacatttttcctggcagtgccaggctatgcagccagttttgactgcgacaacgcaaaaggctacgtagagacatcaatctgtaccaaccctgttctttctaaactggatgatacacttctcagcgtttatgctaaggcgcaggctgcagcacctgaccaagaaatcaatattcgcaatgaacagcgtgaatggctaaagaactcacgtaatactctcacgagtgaagatgccttgattttgtcgtacgaggcccggattgctcagctttcgaaagcgaatgtttcgattccagcatcggctgcatctgaaaccccggtatcaacgccagactgaatcctctcaatctgtcgatttctctcaatgagtcgcctcttgtaggataatgcccctaaaaatgggggcattatctgtgatgtctatgataaccactcccaatgagtttctatgctatcagccagtgatattaggtttttactttttcttatctcgaccggcattttggtcattctgcttttcatttatggcgtagttaaaatcgaaacagataaaggcaagctcgccattttattatctttcctatttgtcgttttctatatagtcacgacccatgcacctgagtaaacaaaattaacaatctaaaaacgaccccagccgataaccacgttgcgcgatagcgggctttaatgtcggagaggtcaaaatcgccaactcggtcaatcgcggataacaataaccactggtcatcaacgtctgatcgataaaggccggatgacacataatttccagcgagttaacgccttgttgatcagcgtgttccagtagctgcaagaacgacggctctgataagttctcaccatagaagccagcgttaaaccactcgctactacgtgggttatcgagagtgagcccatgttgctgcacttcatgtcgatcaatacgcagcgggagtgatttttcacgggcgaaggcggcgactaagggataaatctgcggcaacatatgcacgtgatgatggctgtcaatgtgggtcggagggcggccaaagaccgcactaaaccgctcgaactggcattccagctcttgcgctatctcattcagatccaatgtccctgctccagcacgctgccataaccatttacccagttcaccattcgcgtcggttaaagaaggcattgcggtcaatggacgtccgaaggtcaatacaaaatgcatccccaccggcagtgccggatattgcgcactgagttccgccgcatggttaatatccacactgttcatcattgcggtcgtcgaggagactacgccgttgcggaaggcgtcaatgatcccgtagttttgccctttacacagaccaaaatcatcagcattaacaataagtaatttttccattaaaggttccttgccaaccctctcccactatgggaataaccggttggaaaactaatgggataaactctctctggcgctgtagaagttcttgcgatagtttcctggcgtaaaagaggttaattttttgaagtttttgatgaataacgtggtgtcgctgtagcctgcttcaaatgcaatatccgaaactaaatagttcgtcacttcaagttgggttttggcaaaatttattctaatttcattgataatctgcatgggcgttttctgataatagcgccgtgtcgctctggtgagatattcttgggttttgccagaaagctcgaccatattcaccaacgccttctcactaaacatcgcgttatcatgcattttgtcgattgtggccttcagccacgaaggtatatcgtcgttaacttcactctctttgtaatgactgatgcggttagtcacataaaaggtcagtagctctaaaagttctgtttgctcattttctctgtagtgtggagcagagatcgccgattcgatataggaaagaaaatcacctcttaagcgatacgcctgagaggccacaataggccgagacagtaaatgaaaataatgttcttcaaagaaagctttactgatcccgacattcaggatccgggtggcaccaaactcatagaaactttgatgatgagaaccaagaggaataaagataaagtccccacgctccaaaaaaacacgctttccgttaatttcttggtagcacatcccggttaatatcagcgtatattcataataatcatgctgatgtaaaccagtcgcactctccgttttgttgtaaataaacagatggaattctttaccgttaaaaaagtctctttcacgtactaatctgacgtccatcttattcaccatcgctctaccattgagaattatcgccccgtcggcgtatcactgaattttttgatgcagctcgataagctcagtaatcaattctcgcgctaacatggcattcatcaaatgatcctgagcatgtaccagcaccagggtaactttggttttcccttcgccctgatcggcttcaatcaattgtgtctgcaccaagtgggcgtcattcaaggcgctccgggactgcgccatcagttcatctgcttgtgcaaaatcaccggctttggcctgtttcagtgcgttataggccaggctacgggcttggcccgcgttgatgataagccccatgaccacatcttccagcgcatcactggtttgttcgttatcaacgatgctacttaaatcaaacatacaattactccgtcaatgaaagccatttcgcctggcaacatccgccaatcaatagccactgctctttcgtacttgagtgtctggtccgcatattgagccggaccaatccataacgatttttatcggccttgagccaaaaccataacactcaaacaggttgtaacgcttagaatttcaggctgttagcaatatcgtcttcgctttcgacagtacggtcgatctcgcccctgtgctttattggcaataatcacgaacgggagataaaccagtgttgccacgcccaagttgaacaaacttaataataatgcagcaatgctaccattggtgttaaagaatgcacctagcccggcgggcatagtccacggagcaatattggtgatcggaggaataaggccactgtaataagctactgacgtgataatggctaatatcggctgaaccatgataaacggaataaacatgagtgggttcataatgaccggtaagccaaacaggattggttcgttgatctggaaaatactcgccggagcagccagcttcgcaacctgccgataatcttcacggcgagaggccataaagatggcaataataagccccaacgttgcaccggttccgcccaagaagatgtaggaatcaacaaacggtttcgcccacatatggaactctttacccgcagccagtgcggcctcaaccgaaccatattgggtataggttgccacgttttccaacgcgaacggcatcatgatgccactttccagcgcagacaaggccatggcaccatgtacaccgaagaaccacagcagagaggagaacatcacatacacccaccccacgacactgcccattttcgacagcggggcggagatggaatcgataatgatctgatggaaattagtaccatatagcgccagagtgtatgaaatcaggcccatgatggaaagaatgataaagccaggaatcaatgccgagaaagaacgggaaaccgaagtgggtacactatctggcagacggataatccaattacgtcggacaatgaaagtgaatacttcagccaccaccagaccgatgatgatacccgagatgatattggcccccccgagccaattggcaccaaccgcataggcctcgccaacactgaacggggtcacggtcataaaggctgcgatggccagtaaggcggcagagagtggatccaccttcttctcttcggccagtgccatactgataaagaatggcgtcattaacgacattatcccgagcgttccgttataaacgttaccaccgatggctttccaaccatttagcatggtaatggtatcgccgtctaatcgcacacccattgaaaagaaaaacgacccttcaccgaaacttaagaaaacattattaattagaacaaacatggccccagtcagggttaatggcatcagccggataaacccgttcttgatggcattaacgtgttgctgcctgccaattctaatggcgaagggtaatatgaccttctccaacgacgtaataaatgtgctcacagtgatccccttattgttttgctttttttattgcggccaccgcagcttttaatacccctaacccatcgactttgccgtaaagaagcgtatcaatcacttcgacgggtttattcgggaacattttggctatttcaggcaacatataggcgatctgcggccccagtaggatcacatcagcatgagcaccctgcgccgatgccagcgcttctgggtaagcattgataataaccggcacttcatacttttctgcttgcactttcattttggaaactaatagcgaggtagacatcccagcagagcaaaacagataaatttttttcttttccatacccaacaccttttgatgttcaaaagacacaagttattgatatgccagttgcaatggtaaacgtccctttatctgtacctcattgtgcgccttagctcacttccattgtctctggttgtcggcagtatacggagttggtagataaagcagtaatccaaggcttacaataatcgtctcatattgactttacagattgacaaccttcacatttttcaactatctcaatgtgatggttatcgcaaaatggctaatttttttcttgacgaaataagtttaatccattgatattaaataaatttttattattttgtttacagaagataccctaacttaaggcaatagaaaatagtcagaatataaattagcgaatcttattatttttgctggctgcgaatgttttgtattgaggaaagaaacgccatttagacccaacaggcgtagtgatcaatatgcagattattttgtgtgttaaaacagcaaaatgacgttctcaggctagccgaaaaatagcaagttataggctattcatactaacaggagacagaaaatagctgattctagcattacagcctgataccaatttccgtaataagaattattaaatggacaaccatccattatctgtctagaaagaagatatttgaaaatatgtgaaccgaaagaagttgtcaggctgcgatgggataaataaccctgcaaatattatcagaactaacgcagagccataatccaaggaaacgccctaccgatataaactgtcatacgtaataagtggaatattttttaatcgttatttcagccaaatgttttgacaacaaattaaaaaagaagcgcaatagtgacattcagatattatttcagagtttaatcaataaaaccaccaagccagcgttgttgttattcttttactttattgatggtggacaaaaaacgaatctattatcagattaaaataaataggtacgcgatatttatcattttattgtctactttagactacaattacttgactcaaactaatcgttattgaggctttattatgactgcaatcgatgtaatgtgggtgggattgggcggcggtatcggctcacttttacgatggtggataggattaagtattggcaaagtctataaaggtaattttccactcggtacatttttaattaatatttcaggtgcatttgtcattggctacttgagtattttgttcagtgttgactggcgcgaccgctatggcgacttaatgaatgccgccgtattgactgggattctaggcggttataccaccttcagcagtatgcaattagatgcggccaaactggccacagcccgaggcagagcaattgccgccggatatctgattatttctgtattggtcggtttagctgccgctgccttcggtgcctggctggcttactaattgggaggagtgattatgccgaatcttattatcttagtctttgtcggtggtgcttttggtgccatgtgccgtgaatttattatgctgtcggtaccacgtctggctgatggtttcccgatggatatctttgttgctaatattattgcagcgtttctattagggctgacaacctctttctttaagaaagataaaattaaccagtatgtacatctgatggtaggtactgggattatgggcggtctttcaaccttctccagcttcgtatttggcgcagtagaaatgatgaaaaatcctaccgaagttttggtttcaatctgttatttagtcgccagtttgattgttggttttattgctgtcgagttgggtttgatgatcgggccaaaagagaaacctaaagatccacaagttgcctctgaataaatagcccataaaaaccaaggctcgtgacaaaaaaaacaccctcacttaaccgagggtgttttgatataaacacagtgatagtgggctattaatgatatcaatccagtttctggcaatgaccaaagaacatttccgtaataagggtattattgatggtatcgccattcagagtcctgaccagtaactcactgcctaacaatggcaaagagaagaccatgtctggattgactcttttaactttttctatattctgagtttcattgactaatgccagtattttcgtcccctcacccgaaatttctttagccgctaaaatggtaaaggtgttatcagcatcattgttacacaacacgataatatattttgccttcgccgcaccggctaattttagcgtggcaacagaagaagggtcaccctcgataatatcagcatcggaagggaaatcatgttggctacctaccgcacaaaccacagtgacatcatcaccccggtcacgcagacctttatatacattcagtgccaaacagttggtaccgacaataataaaatgatttttacgttccacgtgagaaatcctacctttaactatgcgtttgatattattactgatcatcgggccggcaatcgaagccactgaggtagcaaaaacagttataccagcaataatcaccgtaagagtaaacattctcgccacagtggtatgcgggataatatccccgaaccccaccgtcgacatacacactatcgcgaaatagaatgctgtagataaatcagtcaccacgggggcaaactcatcacccatatagagcgtacccagcatgctatagacgattaatgaagcgatactcacaacagcaaagaatgtaccgctgccgagactgtaataatcaaaccgccgccaataaaagagcagtgctaagataatcacgatggagtaaatcgtcaggctatcatattttttcgcgataaaaatattgatggcaacaagagtaaatagcagcaataccgataaaaaccatgctgtacgggttttcattgatagtgcatatgccatcaatatcaagaccagaccgatcataaattgcgggatttcaaataattccagaaaacttaacgcctccttccaagtattgaagttatttattgcatcgcttgaatgtgcaatcgcccgatagagtaccgggcttaaaatcagatacccgttaattgccaccaaaatggcaagaaaaatgggtatcgataccttagctctaaattcccgtaatgttttcatcgatagagtaactagaattgttataggtaattttagtatagataagaaacgagaaaaaccatgattaaattaaattatttttgatagaaatcaaatgatagttttatcttaatacgcacaccacacgtatacgtagcattctcacatttacgggagtgaatttaatccacataaaaaacacacttagttattatcataaaacggtattatttactgtagtaacttatttttcatagctttacaccgtgtaaacctcaccacactctattgtgagtaaaaaaaacagatgtagatattggcaatagtgccacttatgaacaataatatatgcaatccaacatatcgcaatcgttggatctttatatcagagagatgtttatcatcatccttcattcattcaatattttgagtatgtacacgccatgtatatactctaaaaattcgagcttcagaaaagcggcaagtgaaaaaaccttgatgggtctatttattttaaggtcaaaaaccagtaagtaattaaaatcattgagagtagctaacgcacatgcagcttgaagtatgatgggtataaaggttattaccgcatttttatttaacaagtaaataaggaaaataaacatgtcctacaaatcactgcgtaatattgcactgactggtttgcttctttccaccgcggcaactacctttgcagcaacgccgacagggaccacaccaagtgatatgacttgcaaagagttcctggatctaaatcctaagtcatttactccggtagtttattgggtattgaacgatgatacccaatataaacaaggtgattatgttgatctgcatgagaccgatactctcgtgacacctaaagtggtcgaggtatgtaagaaggccccagaaagtaaactgtctgaaattaaacaggacattttaaatttcgccaaaaaacacaatatgtaaaaaacacaatatgtaataacaagttcaatatgtaacctgtaaaaaaagacactcattaagcgttatcggttaatgagtgtctctatttattagccttccctaaccaacgcacatacaacttattgtgtcagcgggtctaataattcactcgcaacaaatatgacttagcggcttatatttagcttgtcataaccacggacatagtaattaataatagaaactaaccagcaacatataaacatccctataatccagtaaccgatctgacctaagttctcgctgatattattaattggcgtccagataccaccagttaaatttaacttatcggcaatcaaacccaaggcttcaatgccaccgataaagaaagcaataatcaccgacgcagcggtgatagtgatattgtaataaagtttacgaacaggtttagaaaatgcccagccataagcaccaatcatcacaaaattatccagtgaatcgatcaatgccattccggccgcaaataaaatcggaaacaccattatcgaccacaaattcataccgtgagtggcgctggccgctgatatccccaaaacaccaatttcagttgcggtatcaaaacctaagccaaacaaaaaaccaactggatacatatgccagcttttattaaccatattaaagacacgtttaaacattctggataacagaccaccattattcacgaccagaaggtcaagctcttcatctttataaatatgcccagctttaacttgtttgaattttttatacactgaaatcaggatcgttaaattgagaaaagcaaataacaataaaaaaatggatgacaccaacgtcccgattaaaccaccggtttcgtgaaaccacgccatattattcttaaatgccatggcggtcgcagcaattgccagtgaagctaagatcacaatagttgaatggccgagtgagaaaaaagtcccaacagcaatcggtgttttaccttgttgcatgagtttacgcgtgacgttatcaatagccgcaatatgatccgcatcaaccgcatggcgcaaaccaaaactgtaggccaggaaagccattcccatcagcacggcattatcattaaattcagcaaaagcccagacccaagctaacccattcaccaccaacaggccgattagcaggtagatggctctgcgctttgtttgctgattaccaaaggcgctgctgctggcgattattgtcgtcatattcgcactccagattattttcaaccctacccgttctgacctggcgttatcgctgacaacacgataacgccaataatttgaggtctatatgatcgataaaatatgaccggtaacatgttcagaaccaagaatgtcttaaatttaatcgctactgtcggtgctctggcatgacatctttattcggtaccaggaatagccacgaagccaatacaaaaggcattgttaaagtaggaataccgataggtaataacagggtgttcagtgcgccttgaacgaataccgtaaaaataaccccgataacggtataagctaaaacccgccaactgggtttattgaacgtcgaccccagtgctatcgcggtaagtaccgcactgaaggcataaagcccagcattaatgctgtgatggtccgcctcgaggagggtggcggtgaggatcgccaatatggctccgcacagagcaaaaacagccgcccaaagtgattcaatggccaacccgatgacaaacaggatgcccgcgatcaggctactgaataagaacacctgtgaaacaccatggaacatgctgacgaaaatgttggtgccagcaaacgtattaccggcctctaaaaccagttgctgtggtaaaaccggtgccggtaatccactgctatgtaggccagcaaaggcgtaactggccaataagaccacccaagtggttaagacaaaaggtgccgtcagtgcagccaatttccaggtttttaaaatatcagcgatacaggcagtaacaatcaccgaaacgatactgcccaagacaatgcaggcccatagcaccggtgtggcgatcagaaaggtgggtagtgcggcccccaccagacagccgttataaccgtataaccctgagcgccatgatttccggtcacggatgctcaacccggtaagtgtggcaaccagcgttcccagaacacaaccataagcgaccgccgggttaccttcaccataagcacctatgaatattgcgatgaaaaagaatagcccggtcaatgggttattctgaaacattacctgagcacaaccgcgcaaagccgtatcgataaattcaatgaaaacatttgaattggcaagctgcccccaacctgattggttgactgttttagcattcattattttacccttctacttgaagctgcagcggtattcgctgctctcactcacccggaatcactgattgatgtggctgctttaacttgcttggatcactggctgataaacgaggctgggtacccagcctctcagactgctgacaaaccccgatgactcgatctgaaacggtgaggataggcaggagagtaaagcgtccgcgccacggatggcgcggctcgagcccccagggatgggtttacggcgtctttacgatctgcctgttctctccgtcgctgacactttgtcaataacctccgaggctgggtacccagcctctattcaatagactgacttattcacccttttctccccttaaaatggcgcatcaaaacagcaaaatcagcgccacaaaaattgttcaggcaatgtaacgcctaaaatctcttcgcgggctatcttccaaaattggcgaatctctgcctttacacccgcgctatcaatacccaacgccttgaagactaatccacaatcattaggtagacgcgtcgcaccgctggcaatcccccctttgatgtcaaaatgagccggaacccgtgccagaatgcggtcatgatgttctttgggcgttaataaaatcacgttaccaaacgcatcaaaggtttgcataacacccactgcgtcaaggctttctacttttggttctaatacgtacttctcaacaaacaactctttgcccgccagattttgtgctgccacccgagaggaataaacatcaaaaccgaatcgttcgtcagcatggtgatatttacgcccggacatcagcacttcagaataaatcgcggtcgcagttggatgaatgctgatcgtggtatcagtaataaaacgggaatttcgatgaggaattagcgggtctggcataaattccagataaccgccttcctccacaatgaaattctggatctgcgaggcgtagttcgcattcatcatgtgaacttttgtggctgactgcgtggtgacgtgagcacaagcgcccgcttccacatgcacatcagtagctaaccgatcaccctgcaaaatacaacctgatgtcgaaatcatggtgacacaaggtaactcaggtatttcctcatcccagtacagtgctttttgtaccaatgagggcacccgcctttccatttcggccaaaatactgcgatgttcacgtttggcaaatctcagtttcagatagccactttttccaaccgccccgctacgcatttgcgccggttcatcctgatatttcgctaattccggcgcgttaacacctaatgcgtgagcgcgaacccgtgaaggcgtctccacgatattctggctctgtgctgtcatgcctgttctccttccggctgtacgtgggtaaacaggaaatctcgcataatcatatcaaccagttcttcaatgccctggccagttttgcaattggtcagaatataagggcgattgccgcgcacgactttggtatcactctccatgacatccaggctggcaccgacataaggtgccaggtcaattttattgatcactaaaatgtcggcctgaaccaagccggggccatttttacgaggaattttttcaccctctgccacatcaatgacatagatgtagaagtctgccagtgcgggactgaatgtcagtgtcaggttatccccgccgctttcaatcataatcaggtcgctttcagggaagcgctcttccatctcttctaccgcagcaatgttcatgctcgggtcttcgcgcactgcggtatgtgggcaagcgccagtttctaccccaaggatcttctcttcgtccagaatacctttcagcgtccgttttacctgtttggcatcctcggtcgtcacgatgtcattggtgataatcagtggcttaatgcctcgtttaatcaggatcggggtaataacttcgataatggccgttttccccgaacctaccggaccaccaataccaatacgggttatttttttacgcgctgtgcttttatcggtcacgggataatcctcttcattctttttatctgatttggggtaggtactcggctaacacctcaccgcagcaccctgaattcatttttatcggtacattattcatgtctcgatcgttcacaccgcagtcactcagttactaaagaggcgaacatgggctttcacatgtacggcggccaaaacatccacaatcgggacataagaagacatctggttgatatcgccgatttcggcaatatcgcagaatttctcaatgtcatggttcagttcaaataagatatgctgtgtatcgaaatgcgtaacgcgcatcaagcgcattgccgcacttaaaatggtcattgccacaccgtattgatgcatcacaaccacttcccgctgcccgatcccttgtgctgccataaccaccgcttgagtcaccggataggtgcccgccgtgttgccatttttgatttgttccaaccaccaactgatcaatgggtgctccaccacatgaatcgacatttctgccagctttttacccatgcgggttgccatcaggcggctttcttcatttaacttacgattattaaccgcccaatcagcacggataatgccatcacggtcatctgccacaacagcacgatgagctgcgacaacgcccataccgtcacaactggccgcctgcttcaacgcggtcaaaacgaagcctttcaatgttgctacatcatgaacgatgccggtttgaatggcagattccacgccattggaaaacgtaaaggccccgaccggcagtacggaatcaccaaattgcatgatacgaatgagatctgatgcgttcatcgcggtgcctcgctgcctgaatcagtgtttatggtcgtggtcatgatcaccatggctatggctgtggtcatgatcgtgatcaccatgactgtggccttctccgtgggagtgaataccgtgaatgtgcagaccagagccatggggttcatcaagggggctggcaacatgaacgtgcgtgtcggtatcctcagcaccaccaaacagtagccgggcttcggagttcgtcagcagaggtaaaatctcggcacctttaacgaaacgaaaagggagatgttggaagccgtgcgtcctcatgacggagtccatcatggtggtcgcaacggtcagaggcacatacacctcgttatgcttggtaaccgctttccaatgctgattacccagcgcgtgtcccagttcaaagcaggttttaattaattcatccggtgaacgacttttcagttcactcaagtcaatcaccatcacatcacgtagattgatctgtaccaccacggccacattggtttcttcatcccatgccagtacatcaccatcagccaggaccacgttgcggtcgagagaaatgcccagatccagaccttgagtactggattttcggcaacggcttttttgtgcttcccgttggtccaggatcaaaagatcgaaagtggcatctttcagtttttcccgccaaaccggatcttttttcacattacccagaatgtgctctatcaaaatcatgttgttcactccttgtgtagatcagttgcccacagtaatgacatcctgttcaacgatattcagcccaaggactttcctacaccccatatcaggaactgaattcacccttcgtatctgaagcactggctattaacgacgttcatttgccgcctgcccgcaacaccaataacgttggataccgcctttactgtggacaaactgaatgctgaaaccgggtagtaccctacttactttgagtattacaacgccccggtaacgggattaacgctgctacctcagattagccaaagagaggttagccaaagaaatagcgctgattcatcgacgcagttgcaattggctcacaggtggcatgtaccccatccacttttactgcaaaggtttcaggatccacttcaatgtttggtgtttggtcattacgcaccagatcacgtttggagatcgtgcggcagtttttaaccgctatcacttggcgatccagccccgctttctctttcacaccatcatcaagtgcagcctgagaaacgaaagtgacacaagtgtcttgtagcgttttgcccatcgcgccaaacattgggcggtagaacactggctgtggtgttggcagtgacgcatttggatcgcccatcgcggcccagttaatcatgccacccttgataaccatcttcggtttcgcaccaaagaagcgaggatcccataacaccagatcggccatttttcccacttcaaccgatccgataacatggctaaccccctgtgtaatcgcggggttaatggtgatttttgccacatagcgcagcacgcggaaattatcgttacccgccgcatcttccggcaatttgccccgagccgctttcatcgcatccgcggtttgcaaaatacgcaaccagttctcccccactcgccccatggcttgtgagtcactggagaacatggagataacgcccatatcgtgcagaacgttttcagcagcaatcgtttctgggcgcacacggctttcggcaaaggagacgtcagcaggtacgttcgggttaaggttgtgacacaccataatcatgtcaaacagctcagcctggctgttaacaccatacggcagggtggggttggttgaacttggcagtacgttagtttggctggccacccgaataatatccggcgcatggcccccacccgccccttcggtgtggaacgtgtggatcgtgcgaccttcgaacgcatcgatagtatcttctacataaccacattcattcaggctatcggtatgaaccgaaacctgaatatccacctcatccgccatccgcagcgcatgacgcaaagcattcgccgtcgcgccccagtcttcatgaactttatagcccacaacaccggcaatagcctgttccagcaacgggccgcgcccgtatgaattacctttccccaaaataccaacgttgacaggtaacccctctatcgaacgcagcatttgacggatattccacggccctggtgttacggttgtcccgttagtgccatccgttggaccaatccccccaccaaagaatgtcgcaacaccgttggacagcgcatgataggcctgttgcggggagatgagatgaatatggctatcgataccggcggcagtaagaatcaaatgctcaccagagatagcatcggtgctcacaccgaccaccataccctgcgtcaccccatccataacaccggggttaccgctcttaccgataccggcgattttgccatcgcggataccgacgtcagctttaatcacccctaagcgagcatcgacaatcgtgacgttggtaatcaccaggtcaagcacaccattatcgcgggtcagattattgttggcccccatcccgtcacgcagcgatttcccaccaccgtaaaccgactcttcaccatatccacgcaagtctttttcgatttcgataaacagattggtatcacccaaacggattttatcgccagttgttgggccaaatagacccgcgtattcttgccgagaaatttgaggcatctgtcgctcctttctttttccggtgcgtgtaactgctttaccccattacacgtatgcgaatttcgatgatttgctctgtaaacaaggcgttatttagatgatttaaaaccacgctcggcggcaaggcggatagccgcgagtttatccgggcgctcactgttgggtaccacaccctcaccggtccacccatcgacaagattgttaaaaccatacagtgtctgcttgccgccaaaggggataagcggaacttcagtttcatcaccgggttcaaaacggatagccgtcgtcgaggagatattgaggcgcttgccataagccgctgcacgatcaaattccagtgcgcggttaacctcgaagaaatggaaatgggacccaacctgaattggccggtcaccggtattgcggactttaactttggtcacgggtttattttcgttaaacgtaattggtgtttccgctaaaacgaggccacccagtggcgtattctgttctttactgtctttcgtacttttcttcgcgctcatgcttgaatcctctgcaataatcagttcaggttttactcgcatgttgccgtcactacttaatagggtcgtgtaccgtgaccagacggctgccatcggtaaaaatcgcctcaacctgaacattcgggatcaaatctgccaccccatccatcacatcatctttggtcagcactttactggcttccttcatcacatcttctacggatttgccatctctggctccttccattgcagtcacagtaatgatagaaacagcttccggataattgagtttcaagccacgcgctttgcgcttaaacgccacatcagacagcgtgtagatcatgagcttttcaacttctcttggggtgagctgcataagccctcctgtatcatgttaagaaagtgaaagtgagaaaaagcaactgactaaacctatgatcttcccagcctatatccaaggtctctcgtgttacagccagacaaacgagcgcatcacgatgcgctgactcccgccagtgattcggatgaatgagcgccgctgagaccgctgcaacgtcaatgaagaaggtatatagaagataaagaataggttatttatacccactcgttagaatatttcagaattaagcacatcctcctgtacattaggttaaatccttatctttaacgctaaccctacatttaaacttccattaacctgctgcctgccagcaagctaaaatcaagacaaattatccaccaccctatttgtatgataattttatcgctcagtatttttaccgcgctcagtgagcgaattcaacataaaaacagtgttcagaaatatttttttaccaaagggcaatacgtttactgtatttgtctacactggataattgataataaaatccattacggatttactttacatagtcaataaataattatcatgagttagattttacatcattatttttgtaaaaaaagacgctaaaaatcaattcattgctatagatgcttcacctataaagaatataggctaaaacttggaaatttcaccattattttataactttatagtcaaaagtataaaatcagttaaaattaaaacaaaaaaactttaaaatcaataaattaaaaagcacccaatctgacgcagcatttaccatcaacaccatgaaaaacctgttttacattcaaaaaaacgtaaaatcttatggataagatggctaacggcaagagagcgcctgagggaatcccccccgtaatcagcaatcaataaattcgcattccatgctagagttataatgaacgccaagtctataagacgccaataaattacaggcagaaattaaaacccacacattctaatgtgtaaatttatctcgccacaataacgcccccgatcaagcttgtaactccaatcattaataacaaatatgatctcaatcaatatttttataaaaacaagtgtcattaaaacacctctacaacaatcactattagttattattctagctgtgatatttaatttaatcgcattccacggttctttttagtattaacctatttttagcatcaacctgtttttaccattaacccgtttttaccattgctaaccccaaatggggtttaaccaatggcgttggataaattgtagttttactttctctttcagggatccaaatacgtgaacacactttttctaataatgccttattatggctaaaaacaatgagccctaatcgacggtgttcagcttcttccaataaaacttgccaaatttgagcctgaatacgggcgtctaattgtgcggtaacctcatccgcaatcaaataacgcgtccgtggatccagcgcgcgtaacaaagcaatgcgggccaattcaccacccgataattcatccggcctgcgttgcagccaatcaggattaaccgccatccgcgccaaccaatcagcatcgggccgccaggcatcatgtaggctctcaccggtggtgcgataaggattaaaactttgctctgggtgctgaggaaccagttggaccggacaatatccttttttagctaatggtttcccctctaacaggatatgacccgcagttgccgactgccattgtgctaatacccggcccagcgtcgttttaccaaagccactgggtgctgagatacctaatcgttcccctggtgccaaagtgaaggataccgactcccatagccgctttccgctttgaacgatggtcagattctcgacactaagcatagtcggccacctcagccagtgggattggcttgctgacaaattgctgttccggtaatgcggcccagagtgactgcaaccatgggctaccaccgctatttttcagttcgtcagcgctcaatgtttcgtgcaactcacctttatgtaacaccgcaattttatcggcaaaacgtgcggccaacgctaaatcatgggttacccacagaataccgcgcccctgctgacaaaaagcacgcagatgcgtcagtaactggcaagcatggtcttcatctagccatgaggtcacttcatcggccagaatatagcgggcatgggtcaaggtcgcgcagctggtcagtacccgtttcgccatgccgcctgagagctgacgcgggaaatcatttaccagccccggcgcaagattataagttttcaactgcatggcgacatcgtccaaacgcagttttacaccactgagttgcgctgctcgggtgatttgtgagccaactttaatcagtgggttcagagcactgacgccttgggggacataacataaggttttaccccgctgctcaattttatcgcgggcgcacagtacctcaccatcgaggataatctcgccatggcaccgcatattctccggcaataaacccaagacactttggagtaacaagctcttaccctctccactcccgccgaccaatgccaccaattcccccggattcacatccagagaaatatggctcaacaacgggtgccaggttttccggcccaaccaacgataatgagcgacatcaatagcaaattggtcaaatctcagcatcaggctaacctcacccagagttgttgtagtgatcgcgcgaactgatcaaatatcagcaccaatcccaccaaaatcaagccaggaaaaaatgccagccaccatgacccactgctcagataacgtaaagcatcggccagtaatatccccaatgacggttcatgaggcgcaagcccgaagcccaaaaagctgagtgcggcactgtgcaacaccgcatggggaaacatcaacagtgtgccaacaatccactgtggtagtaataacggtagcagatgatgacgccaacagtagaaattactgttgcccagccgatgagacagcatcacataatctgtctcacgaatacgtaaaatctcggcgcgtaaaatcaaggccagctttggccagtgggtcaatgctaccgccaggataaccccttgtttcccgcctcctaacgtgaagcaaatcaggactaacagcaataaatgaggcaatgccaacatactgtcaatcaacccacggatcagataatcgagggttttattaacggcacataaactggccgtcagcatggcgagcagaccactggcaaacgcggcaatcaggccaatttgcaagctggtagtcattccctgaaaacagcgcagccataaatcgcgccccaagctatcagtaccaaaccaataggtcgttgaaggtggttggcggcgggccattaaatccattggaacttcagcgccataaattagccaaccataaacgattaaaatagataataagaccagtgagacgaacagccggaacaaggcccggtttgggttataagtcataattgccgcgcagccccccggttcaaacggtgtaacaaggcattcgcaatgctattaccgcaaaagaccaatatggcgcagaacatcactattcccatcaagagtggaatgtcaccatgcaacccggcatcaatcgtcgcctgccccaaaccgggataggcgaacactttttcggccaataaagacccccccagtaattcgccaactgaagcgaattgcaggcaaagcgcgggtgtaatggcatggcgtaaaatatggaagttcaccaaaggccagcctttatccccctgtgcttgtgcatagcgaataaattcgctattcatcacttcagcaactctggcacgggtatgcagtgcaatgttcccaacccccagtaaccccagcgctagcatcggtaaaatcaggtggtgaagcttatccccccaactggcggtctcggcctgactccctggcgtccatgcacagcaaatgggggcccaattgagcttcaccgcaaataacgacaacaacaatagaccgatccaaaaggtgggcaacgatgccaataaataggacaacgttgaaatcagacgatcaggccaacggttgagatagcgcccagcggtcaaccccaatagcaacccgacaattcccgaaaatagccaggccgataccaataacgcaaacgaggtagcaaaacgctcacctatcacctgagaaaccggcgcgttatacagcatcgagtaaccaaaatccccttggagcacttgagtaaaccaatgcaaaaaacgttgccacaaaggtaaatccagcccccaacgagccgcaatcagtgggtattgctctggcggcacatgcagtaaatcgctaccaatataggcacgtatagggtcaacaggggaaaaactcagcaatgtaaaagtaccggctgcggtgaccagcagcaggcaaattaagcgcagagtaaacagcgagatccccttcattactgacaggtccatttccagctatcaatactattgagcaatgaccaggagccgtgaatttccggtgttcctttacctaaatcaacgcagttattggccagataagtatgctggatgttcaacaaccatgcccacgcagcatcgccacggataccggcaccggtcgtaccatcccaatccacctgttgccagaagggtaccgcttgctgccaggtcggtgcatccaacgcctgttgcagatgtttatcgaccatcggattcttgtagtaaccggggttataatattcaacaccagccgcattgctgctgtaatgatgatacaactccataggatcaagactcccccagccaaataaagttgggttggcatgcatattgcgctcaaccgtttcccaactgccggattttaaatccacatcgataccgataggtttcaacatcgagcgtaacgcctgtgccaaatcccggcgggtggtatcaccgctggtataccaaagcgttatcttagccggtaggccatttttctctctgatgccttggctattaagctgccagcccgcttgctccaatatctgtttagctttatcaatatcaccatctttaatcgctgaatcagggttattccatggcaagccctgcactccggtataggccggaatagcatgaccttccatgatttgatcggccaataattggcgattaatggcgtagttaatggcacgacggatagcaacatcggcggtcacatcattgccaatggggtaaccatgtgcgtcttttttacccgcaggagtagtcgggaacacaacgccacgattttcgacgcttggccggacccataacttcatgttattaaccgagcctactgccatggagggagggatacgcacgacacctaattgcccactttgcgcggcagcgaaggcactatcttcatcaaggaaaacaaaaatcaatttatcaaaatcgttcttattgcccgcgtaataagggttagcttccacgatcatttgctgacccggctggaaactcactaaacgatagggacccgcgccaataggtttttgtgcataggtttttgcattgtatttatcggctgaaacaatgcccagtgaacccagcacattcacaaatgtactttgtggtgctttcaagtggatgcggacattgaggggatcgataacttcagcgctgaggaaattccccatatccactttcccgccactggccgcggcgttgttgtaggtaaaagccacatcttttgcggtgagaggagagccatctgagaacttaaggtcaggcttaagtgtcagcaaccacgtttttccatcatcactaggctggtactggctgagcaacagactatcccaactaaaatcttcattttgtttcagtagcgggctgtgaagtaatagatagctaccgtgactccagcctaacatggggtcaaaaccttcggtcggctcatcaccgatagctaattgcaatgtgtgagttgcggcactcactgggacagaaaaaacgctcaataacgcagttgccaccaaggtgtttcgaagccatagacgtctagacattaatcttcctttgataaatcaatcagcgaatatataagtgattgcctgtcaggcacagattcaacgaattattaagcgtagcactaaacataaatatgggtaatgcatgctcataacagcattagcgtctgattctcaccctttaaaaaggaacattaaagaagttaacccatgaatttcagaattatatgataaaaatcaaaataaaatcagacaaaaataaaatagataaaacatgaaattgatctagaacccaaaaaagacaaataaattttttttaatttttctcattctgttcaatatgacatctgatcaagccactgacctattagtagcaaagagcccaaagtagtagaaaagaaccaaaagccccagtctattgattggcttgattattattctcacgctaacttattgagtgaattatctacggtaatcgggttattattttcacctaaattagcctattttttgaacacaccaaaggcatcaggcaaaggctcatgcgtattacaacccaaaaaatgagccgatataaatgagttgattcaggtgttcatatttaacgaaacgagtttgagaatagctaacatggcgaaaacatcaagcaagaggaagggggataggttgtaggtggtaggtggtaggtggtaggtggtaggtggtaggtggtaggtggtaggtgataacaagagttacaatttttgtcgccccaaaaaataataaaaaaaaccccgtcaaaagacgaggcttctaaatctatttacagctaaacgttaacaacagtaatgtgaattacagtgctacaacgtttacagctgaagggcctttttggccttgctcgatgctgaactcaacgttctggccttcatcaagagttttgtagtcattaccctggattgcagagaaatgtacaaatacatctttgctgccgtctgcaggagaaataaaaccaaaacctttaccagcatcaaaccattttaccaaaccagtcattttattagacataaatatatttccttcattattttgtgccactacatggcaattgaggtctgcttgagttacttatgggggcacaaaagaaggtaattcgtcggagaagtgatgtctaaaaaatatcgctttaactaggaactctttactttaaatggcttacataaataggtctgtgctacaaaccgatgacgctattaacgcatgatgaggcactaatagcaagacttaattattacacttgcgaataggtaacaaagaaataaattgtgtctccgtggtggcaagcggacaataatgcatcagctgacggggtccacgaccagtcgtttcaccgtctgttgatgaaccaatattggtcgaaccacaatattggctcacctataatatcatcggttaccctacaatatcatcggttagcccacaatcaggaagacaagacagagttgatggatgaggttatgctcagatttcgttatactgccgctggaaatcggaagacgccataaaggaaaagcaatgacaatgcgtgagcttgaagtacaatttctcaaagcaatgagtgagttgcagtcaacttttgagaaacagcataagacatggcaatcaagctataatgcgttgcaatatgagctggaacaatcaaaagcccgggaaagcgcattgcgggtgaagaatgagatgctgctaagaaaactcaatacggcgaatacactaccggaacagcattcactggtcaggcaaatgaaaatgctgggggcacaccttgatgctctggcaaaagatgctgccgcgtttaatcttcacctgaatagtcagcacaaaaatactgataacttcagtggcgataatacgtgagtactttgttgatgttgtctatttatggcaatctaatattttatgacaatttaataacttatagcaatttaataacttatcgcaatttaacaacttatggaaatttaataagccgatagatttacattgctaaattcatcttctatggcgtaaagaaaccttaaatgacgtggataattattgctgttttgatcgtggtttttattgtgggctatcgtgtattgacatcagatacccgcaaagctatcgatacaatctctaacctactgaaaataaaaccgatttatattgaatcgatgttgcaagagatggggccacgccaaacgcaaatgtttattcgctccaccagcaatggctcggcagaagaggttagaaaggcagcttatttagtttttatttatcatacttttatcaaaaacccttcggatgaaaatgtggagctgtggcgaaataccctgatccgcgcacagatctcccctattctggcagcagagcataccgacgccgctttgttttattttgccgaactggatttagatgcctttgaattggcacaatttcggcgtcattataatctgcattttaatccagaacccggcaccctgcttcattagtgatgttctattacctacccattagcatcgtggatatggctgcattattatctgattttctcgcgacatcagataggcagtcagccttatcatggcgctattcgaacatccggcctaagaaattcagtaacaactctcttgaactaaaaccatgcgcaataccataatactcaccgatagcaccaaccaaatagagagggaattcaatatatttattactagttttaattaatgctgtaggcatcgacaacccaatgctcttatctttttgagatggatgaataattaatgctgttcggcccatataggattcacgattaacataaacataatgccttcccttttgataaccatacgcttcattaactgtatatacacgttcaaaacccgcattttccaaaactttagcgacttcatcaggtctcagatacataaattgtcctaattttaagtattcttataatttactatcccattaaaaacatacattaaacagaaatttgtcatttcattaagatatttaggatttttcttttttgtaacaaaaaaaacaatgagcgtatatttatgtaattttttatgattaataattgtaatattaataaaatatcaaactaaataatttacgtttagcttaaattaatggacatgcaataactgactatacttcaaataatagtttacgtcagtgattcaggtgaatggaagcggttaatactgcagaaatggaacgtcgaaaaaagataaaaatattggtcaaaacagcgtattggtgatccccaacaatatcactgcgctgaaaataagttcgaaccaagagtaatgaatcataatgataagcttataaaaaaacacccacaattaagtgggtgattgggattaacctgatgatacaacctctgggggcgaccttatgctgcgggtgccgctactggttttttagccgttttatggtgctttttcgctgcctgtgctttttgcacgggcgctttttgaactgatgcttttttcacatgctttttcgctgcttgtgctttctgcacgggtgctttttgaactgatgcttttttctcgtgttttttagcagcctgtgctttctgttctgtggttttcttcgtcactttatgtttttgatgttgagttgctttagtttgagcagcaacagtggctgtcgtactggttgccgcaggtgtagccgttgctgttgtgtcagcagcgaaagcaactgaagatagacccagggtggcggcaaccattaatgctaatacttttttcattttcaaatcctcagagtttgtttcgctaagcccccaatgggccgttggaataaatcatagaggaacaagatttgcccttccgtgagtcattggtttcgctaagtaaccaaatgtacagcctggtcgtcatgatcgggtccagtcaatgttttgatctagcaaatgttttgatccagtaaaaaattagcacggctcatcaccgagatccctctctacgatcccccttctttgttctgtaataaaatattttcccccggctaaccacccccaaattctgctgccagccctgtgctgacggccttatccctgaatagcggattaaataggcaaaaataactacatgtagtgtggttgaattaaataagcaccacatatagtattttgtcatcacttgcggaaatgaatacgcagatgataatcataggccaccgtggtacgtcatacggaccccatagcagcctgaagggtatgattttcctttaacataaaaggtaaatacgaatcatgagcattattatttacagcaaacctgactgtgtccagtgtaatgccacctaccgggcattcgacagacaaggcatctcatatcaaatcattgatttaacagaagatgaacaggcactaaaccatgtcaaatcgttgggttatcagcaagttcccgtgattgtggcaggagatgagcattggtcaggcttccacccggataagattaatgcactggttcaggcggtcagtgtttgatgaggtcgatgacatgaatccgctggtttatttctccagcagctcggagaactcccatcgttttgtcgaaaagttacaactacccgccatccggatccctattgccggggcgcgggaaaagctacgggttgagcagccctatattttgttggtacctagctatggggggggcagcccggttggcgcggtacctattcaggtcattcggttcctgaacgatgttcataaccgttcattgatccgcggtgttattgccgcgggcaacactaattttggcgacgcctactgtctggcgggggatattatctcccacaagtgtcaggttccttacctgtatcgctttgaactcctaggtacagcagaagatgtggcaaacgttcgcaagggagtaactgaattttggcaacgacaaaactgaacgtcatcgattcatccgacagtgagctggattatcactcactgaatgcaatgctgaacctttatgatgctgatgggcgtatccagtttgataaagaccggctggccgcacggcaatactttttgcagcacgttaatcaaaacacggtgttcttccataatctacaggaaaaaattgattacctgattgaggagggatattacgaaaaagaggttctggatcaatacgattttagctttatcaaaagtctattccagcaagcctatagcaaaaaatttcgtttccccacttttctcggggcgtttaaatattacaccagctacaccctaaaaacctttgatggcaaacgttacctggaacgctatgaagatcgcgtttgcatggtcgcactgacactggctacaggtaaccagacactggcgcgggaactggtagaagaaattatctctggccgcttccaacccgccacaccaaccttcctcaattgtggcaaaaaacaacgtggtgaactggtctcctgcttcctgttgcgtatcgaagacaatatggaatccattggccgctcgattaactcggcactgcaactctctaaacgtggcggaggcgtggcgttcctcctcagcaatatccgtgaggtgggtgctcccatcaaacggattgaaaatcagtcttcgggtgttatcccgataatgaaaatgttggaggacgcgttctcctatgccaatcagttgggtgcccgtcagggggctggggcggtctatctccatgcccatcatccagatattttgcgttttctggataccaagcgggaaaatgccgatgaaaaagtacggattaagaccttatcgttgggggtggtgataccggatatcacttttgaactggcgaagaataatgaagaaatgtacctgttttcaccttatgacattgaacaggtttacggcgtgcctatgtctgaaatcagcatcagcgaaaaataccgcgaaatggtggataacaaacgcatccgcaaaagcaaaattaaagcccgcgagttcttccaaattctggctgagatccaatttgaatctggctacccttatatgatgtttgaagatacggttaatcgcgctaatccgattaaaggccggattaatatgagtaatttgtgttcggaaattttgcaggtcaacgcccccactgaataccacgaagacctcagctatcgccatatcgggaaagatatctcctgtaatcttggctcgctgaatatcgcgcaggtgatggattcacccgattttggtaaatccattgagatcgccattcgtgggctcactgccgtatctgaaatgagcaatattcgctcagtgccatccattgaaaaaggcaatcaagaatcacatgccattggccttgggcagatgaacctgcacggttatctggcgcgggagcgtcttttttacggctcggaagaggcgttggattttaccaatatctatttttataccgtggcgtatcacgcgatccgtgcctcaaaccagttggcaatagaacgggccagccatttcaaaggcttcgatgaatcagattatgcttcgggtgctttcttcagcaaatatatcgagcaaagctggcagccaaaaacagcaagagtacaggcactgtttgccgatgccggtattgccataccaaaccaacaagattggatcgcgctacggcaatccgttatggaacacggtatttataatcagaacctacaggcggtgccaccaacaggctctatttcctatatcaatcattcgacatcaagtatccacccgattgtctctccgattgagatccgtaaagaaggcaaaataggccgtgtttattatcccgcaccctatatgaccaacgataaccttgaatattatcaagatgcctaccagatcgggcctgaaaaaatcatcgatacctatgccgcagcgacccaacatgttgatcagggcctctctctgacgctgttcttccgtgataccgctaccacccgcgatattaacaaagcacagatttacgcttggaagaaagggatcaagaccatttattacatccggctacgtcagatggcattagagggaaccgaagtcgagggctgcgtttcctgttcgctgtaatgtcttttctgtttacggcaacttttctgtttacggtaactttcctgctcacggtaaatagatagcactgaattaatcaggtcggatagattaaggaaacaatgatatgaacgtagtaaaaccaataacacgtatcagcgccatcaactggaataaaattgaagacgataaagatctggaagtgtggaaccgcctgacatctaatttttggctgccggaaaaagtcccgctgtcgaatgatattccgtcgtgggcgacactcacgccacatgaacaacaactgactatccgggtttttaccggcctcacgctattggatacgatccagaatacactgggcgcacctgcattaattaaagatgcgattaccccccatgaggaagcgatattttcaaatatcagctttatggaggccgtacacgcacgttcttatagctctattttttctacactttgtctgacatcagatgtagacgatgcctaccgttggagtgaggataatgggccactccaaaagaaagctgatattatttcacagcattaccataatgacgatccgctgaagaaaaaaatagccagtgtatttttggaatcatttttattctattccggattttatttacccatgtattggtccagtagagctaaattaaccaacaccgcagatcttattcggcttattattcgggacgaagctgtccatggatattatatcggctataagtttcaaaaggggttgggaaaaatagatagtgcccatcgtcaggaaataaagaatttcgctttcgacctactgcaagatctctatgataatgaagtgcgttataccgaagatctgtatgaccacgttggctggacagaggatgtaaaaaaatttctccactacaatgccaataaagcactcatgaatttaggctatgaggcattatttcccgccagccaggcggcggtcagccctgcaattctggccgcgttgtcgccaaacgcagatgaaaaccacgattttttctccggatcaggttcatcttatgtgatcggtaaagcggtcaatactgaagacgaagattgggatttttaagatttccccacacggcggccctcctttttagtctagataaaaaaggaaatattctagataaaaaagggggagactcagccccaataggcagttagccaatcgccccctaatatgccttatcgcttaccgccgtaagtcgtcgcatttacggctatatgaccgccatcatctcacttcgctatagcctgcttaatgagcatgttatgtgctgaatttaactattatcatctgtttattggcattcaggccagagcacaaggggaatacaccgaacgcaacaaggacgtataacgaacgtgtcgaatgagtaatatcgcacaaatatcatgcaatacatgaactcatagaagaaggatataatcagtcaccttatagcgaaatacattacagatatatgcatgacaattaaccgactcgcggcctaattacccttaattctttgtgccaatattcaacggttaataaaccctaaaaaacacattattaacatagatatatacacccatctaaaagccatatattagtaatgagataaaataaaaatcgcatataagaaaattgagggttgtctcagattctcactgtgttagggtatatagcgttttatattttcatcaggataacattgatcgaataaacaaaaatttaaaactgacagagggatatacctactgcatggcaattaaactcgaagtaaagaacttatataaagtatttggtgaacatccggaacgggcttttaaactgcttgaatcaggtaaaaataaagagcagatatttgccaaaaccggtttatccgttggtgtcaaagatgccaatctggccattgaagaaggcgagatattcgtcatcatggggttatccggttccggtaaatccacactggtacgccttctcaatcgtctgatagaacccacccgtggtgaagtactgatcgatggtgaagatattgccaaaatatctgacagtgccctgcgcaccgtacgccgtaataagatcagtatggtatttcaatcctttgcattaatgccgcatttaaatgtattagataataccgcatttggcatggaattagcgggcatcccattgctggaacgcaatgaaaaagcattagaagcattgcgtcaggtcagtttggatagctatgccaattcctatcctgacgaactttccggtgggatgcgccagcgtgttggcttagccagagcaatggccaataatccggatatcctattaatggatgaggccttttcagcccttgaccccttaatacgtaccgaaatgcaagatgagctggtcaagttacaagccaagcatcagcgaaccattgtttttatttcccatgacctggatgaagctatgcgtattggcgatcgtattgccattatgcaaggtggtgaagttgtgcaagtggggacaccggatgagatcctcaataatccagccaatgattatgtgcgtaccttcttccgtggtgtcgatattactcatgtcttcagtgccaaagatatcgcccgccgtcgtcctgcttcattaatccgtaaaacaccgggtttcggcccgcgttcagcgttaaaactgcttcaggatgaaaaccgtgattacggttatgtgctggaacgcggtcaaaaattcattggcgtagtatcgatagaatcactgaaaaaagcattggcagaacatcaaccgttggatagcgcgttgctggctgaacccgcacctgttcctgctgatatgcccctcagtgagctgatttcattggtggcacaggctccgtgtgcggtcccggtgatcggtgaagacagtagctatatcggtattatttcaaaagccatgctcttgcaggccctagataaggagacgccaaatgagtgatcaaattcaggtgaacgaacaaacagtcaataatccgtgggcaactgatacggcaacatcagtcgctcccacggttaccgatagtgcacctcagagcctgtcagccgctgctgacccatggggagcaagcatggccgaggggagcaatagcgtagggtctgcaacgcatgaggcggcgtctcaggccgcacaaaataccgattggttgaacagcgcacctaccccagcaccagaacatttcagcctgatggacccgttccagaatacgtggatcccactggactcgtgggttacccaaggtattgattgggtcgttctgcactttcgtccgctgtttcaggggatccgcgtaccggttgattttatcctcagcggctttcagacattgttactggggatgcccgcacccgtagcgattttagttttcgccctgatagcctggcagttttccacgctcagtatgggcgcggcaaccttgatatcactgattgccatcggtgctatcggcgcatggtcgcaggccatggtgaccttggcactggttctgacctccctgttcttctgtattctgattgggctccccctcggaatctggctggcgcgcagcaataatgccgcccggattattcggcccttactggatgcaatgcagaccacacccgcgttcgtctatctggtccccatcgttatgctgttcggtatcggtaacgtccccggtgtcgtggtgacgattatttttgccctgccccctattgtccgcctgaccattctcggcatcaaacaagtaccggaagatctgattgaagcagcggagtcctttggtgccaacccgcgtcagttgctgttcaaagtacagctaccgctggcgatgccaaccattatggctggggtgaaccaaacgttgatgctggcattgtccatggtggttatcgcttcaatgattgcagtgggtggtttaggtcagatggtcctgcgcggtattggtcgtctggatatggggctggctgccgtaggcggcgtcggtattgtgatcctcgccattattttggatcgcttaacccaatcattaggtcgtgatcgccgcagtaaaggcactggtcgctggtataccacagggcctgttgggttgctcaccaaacccttctgtaacagcaaataatttcaattaattacgctcaaataaaatagcttaaaaaaggaaaaactatgcgcacgacaggaatctgggccttggccctcaccacactgatcagctctcagttatccgcagcagaattgccgggcaaaggtatcaccgtccagcctctgcaaagcaccatttcggaagaaaccttccagacctcgctggtcaataaagcgttggaaaaactcggttacgacgtccaacccacgaaagaagtcgattacaatgtcgcctactcctccattgctgcaggtgatgcaacctatctggcggtaaattgggtgccactgcataacgatcaatataatgcagccggtggtgatgctaaattttaccggcagggtaactatattgaaggcttggcacagggttatctgatcgataaaaaaacagccgaccaatacaacatcaccaatattgcacagttaaaagacccgaaaatagccaaattgtttgatgccaataatgatggcaaagccgatctgaccggctgtaaccccggctggggttgtgaggccccaattaaccatcagatcaaagcttacggcctgagcgatacggtgacccataatcagggtaactatgccgccatgattgccgataccattacccgttacaaagaaggcaagcccattctgtattacacttggacgccttattgggtcagtgacgtattggtgccgggccgtgatgtcgtgtggctacaagttcccttctcttccttgccagacaaaactatcgatacccagctttctaatggcgcgaactatggtttcccacctagcgtcatgcatattgtggcgaacaaaaaatgggctgaagccaatccggcagccgccaagcttttctctatcatgaaattatctattaatgatgtgaatgctcaaaacatgcggatgcacagtggtgaatcctcagatgccgatattgaacgccatgtaaatggctggatcaacgctcatcaggcgaccttcgatggttgggtaaaaaccgcggctgaagcggctaattcccaaacggcgcagtaagttaagagaaaacagatactttcgggtatctgtgaggttattgacaaagtgcccgcgacggagagaacaggcagatcgtaaagacgccgtaaatacatccatgtaggctcgagccgcgccatccttggcgcggacgctttactcctctgcctatcctcaccgttcaagatcgcgtcatcggggtttgtcagcagtctgacagatactttcgggtatctgttttttatccctaccggccattgataccttcaaacgggtgatgtttaacccaatgctccgcaatctcttgacgccgacaaacccacaccctttcgtgttgctggatataatccaaaaagcgctgcaaagcccggaaacgtccagggcgccctaataaccgacagtgcatccccactgacatcattttaggtgcagtttcaccctctgcgtacaacacatcgaagctgtcttttaaataggtataaaactgctcactggagttaaatccctgtgctgaggcaaaacgcatatcattggcatccagtgtataaggcacgaccagatgtggggtggtactgccatcaactcccctgacctgcgaccaaaagggcaaatcatcgccataataatcgctgtcgtacagaaggtgaccattctccaccaccagccgccgggtatttgggctatcacgcccggtataccagcctgcagggggttggccgaataaatcatgtaatatcttgatggcccgctgcatatgctcacgttcagtttgctcatcgacgtgttgataatggagccaacgccagccatggcaaaccacatcataacccgcacacttaatcgcttcgacaatcaatggattacgctccaatgccatggcaacaccaaagaccgtcataggcagcccccgagaaacaaactcctgatggatacgccagaagccagcacgagttccatattcgtaaagtgactccatcgacatatgcctatcgggataactgtccgcaccgataatatcggaaagaaattgttcagatcccgcatcgccatgtagaacgttattttccgcaccttcttcaatattcaggacaaattgcaccgcaatacgtgcctgccccggccagttagcgactgggggttggccaccgtaaccggccaaatcccgtggataatcatgattaagttcagtctcatgcattggcatactccattatgtctatccactgactcgttgaaacggcaagacatcccacatcatcacctttgctgccttccatccctttgttgccttccaccccttccctgattgtatataaaaaacacatagattgtatatattatgtatataaattgtatgttaattgtacataaaattcatttacgttccgctgatacaacaatttttagtctgagttctgcaaatatctctagccctaactctgtaaatatttctcatgtgaggttcgacaaaccttgtctcacatcatctgaatgttgcctttggaaggaacgcgctttatgccaaataatgaaaaaatctcggctagcagcattaacccccactacagtcccaaactcactaatgaagatctggccccaactcgtaagcagaactggggctggtacaatatcttttcattttggatgacggatgtgcacagcatggggggttatgtggtcgccgccagcttctttgctctcgggctatccagttggcaagtgctgttatcgctattagtcggtatttgcattgtacaaatttgcgccaatctggtggccaaaccaagccagatagccggtgtgccctatgccgttatctgtcgacaatcttttggggtatttggagcaaatatcccagccgttatccgtgggctgatcgccgttgcctggtatggcattcaaacctatctggcgggtaatgcttttatgctcgtgatgctgaaattcttccccagcctgatccccctgactcagagccaatggctagggttatccaccctcggctggatctgtttctccattatgtgggtactgcaggcgatggtgttctggcatgggatgaatgcgattaagcgctttattgattttgccgggccggcagtctatgtcgtgatgctgtcattggcgttatggattgtctatcaaaccggctggagtaacatttcattcaccctcgccagtaaaatcttaagcccatcagaacaggtctggcagatgctgacggcaaccgcgctggtcgtctcttattttgccgggccattactgaactttggtgatttctcccgctatggcaaaagtatgcaggaaatccgccgaggcaaccgatgggggctaccctttaacttcctcctgttctctctcgtcaccgtggtgattgtctccggctcacagtcgctgttcggtgaaatgattaccgaccctatcgagaccgttacccgcgtcggcaatggcgtggctatcgctctaggtctactgaccatgattatcgccactatcgggattaatatcgtcgcaaactttgtttcacccgcctttgatttttctaactgttcaccacaaagaatcaacttccgtactggtgggatgatagctgcggtaggttcagttttgcttaccccatggaacctgttccaatcaccaatcattatccactacaccctggacgtgctgggtgcctttatggggccgctatttggtattttaatcgctgatttttatctgattaaacgcggccaattatatgtagatgatctgtttaatgcttcatcatcaggacgttattggtatcgcggaggttttaatccgaaagcgattatggcgttactgcccgcagtggccattggcttgatgatcattttcatccccaacctacagcagatctccagtttcagttggtttatcggggcgtttcttggcgggagtatttatcgctttattgcacgcaatgacccattgccgaacaatgcggctctgtttatacgccctgaaataggcaaagattgagttaagcagaaacgacaaagccctgagttattacttaactcagggcttctaaattttggcggtgcggacgggactcgaacccgcgacccccggcgtgacaggccggtattctaaccgactgaactaccgcaccacgctgctgttccggttaagaacgagatggatagtacggttagaacggaatggcgtcaacactttttccagtgaaataagccatttgcacagtttttcatctgagtgtgcttttattctgcttttgtctcttcttctgcctcaagcggcatccgccacaggcaactgccgccctttttcatcacaaaatccaaacgggattcatgattagccaattcatcctcggtagcatagataattttcaatgccgatgctgggcgagtaatgcgttgaatatcttcagacgcgttattctgcgacacttcgccttccatggagaaagttagcgatgtctgcccgccagtcattgctaaataaacttcagccagaatctcggcatcaagtaacgcaccgtgcaaggttcgtttggtattatctatctgatagcgatcacacagggcatcaaggttattccgcttaccgggaaataagcggcgagccatcaacaggctatcagtgatagtacagaaggtctccgttttcggaatatcttgctgcaacatccggaactcgtaatccataaagccgatatcaaacgcagcattatggatgactaattcagcgccacggataaaatctaaaaactccggcgtaatatcagcaaatgttggcttgtcagccaaaaactcatcgctgatcccgtgcaccccgtaagcttctggatcaaccaaacggtcgggcttcacatatacatggaaatttctgccggtcaggcggcggttgataacttcaacggcaccgatttcaataatacgatggccttcataatgaacgccaagcttattcataccggtagtttcagtatccagaacaatctgtctggtcggtgtaatgatcatattgcagtgctcacagcgctcgtttatgtcagacttgacgtttaaacagataggaagagtctaccagagatgactaaacaggtagaaattttcaccgatggctcctgcctcggtaatccaggccctgggggctatggcgcaattttacgttacaaacaacacgaaaaaacgtttagtgccggctattatttgaccaccaacaaccgtatggaactgatggcagccattgtggcgcttgaggcattgacctcgccttgcgaagtgaccctaagtactgatagccaatatgtgcgtcagggtatcactcaatggatccataactggaaaaaacgcggctggaaaacagccgatcgcaagccagtgcgcaatgtggacttatggcagcgtctggatttagctattcagagccataccatacagtgggagtgggttaagggccatgcgggtcatccagaaaacgaacgttgcgatgaactggcccggcagggagctaattcaccgacactcgatgatacgggctataaccctgattaatcctactagcttcgcgtgttagcggctcttactcattcgaatgattgacttgagtcagggttgatcccggtaactttttgttgcaccaacggcccggctaaaccaaggtttacgtacgccgaacttcatcggattgaacgtcaatggcaccgtgcgtttccgggcaataattagattgacacatcccaacgcaggcaggtgggtactgataaagtgcccaccgtttttattgaagggcaaaacgtgaaagcacgataaatgtactacttcataattcagcaaactcagccaatccagcaaacgcatttgagtaaacatccggctgatgtatggctgtcgctgacgtaataccggcaccaattttcccaagcctaacaaactgaatggattgaaaccgctgataaccagccaaccatcatcaattaataccctatcgacttcacgtagaatacggtgcgggttagcggcataagccaaagtatgggaaagtaagcaagcatctaccgatttttcagcaaagggtaactgataaggactggcgagcacctgcatatttttgccccactccccgacattaacctgatgagcaatcgcacatttatcgctggcaatttcagcacttaaatgaccaaccttcagcaagtgaaaaccaaaaaattttggccaccagggttgcagttgctgttcaagcgccgcgcggtaatattccccccaaggtaattcagcccaagatgcaggtgtctcaatattttggcgtatttgcgctggtttcatattttattatcttctttcaagctgttgccaacgagaggtatctaatgaatcttatcagcattccggcatttcaagacaattacatttggctactggctaatcgacaaaaacactgtgttatcgttgaccctggtgagtcagcgccagttctagccacgctggcccaaggccaatatgtgccacaagccatattattgacccatcatcataacgatcacgtggggggggttgctgatttacgccaccatttccccgatattcccgtctatgggccacaagaaactgcgaaaaaaggggccaccgtcattgttaatgatggcgatagcctcaccattgccggacaaaattacaccattatagccgtccccggccatactctaggtcatatcgcatactacagttctccttatcttttttgtggagacaccctgttttctgctggctgtgggcgactcttagaaggcacaccagagcaaatgtacgcttcaattcaacgactcgcgcagttacccgacgaaaccttaatatgctgcgcacatgaatatactctctcaaatcttaagtttgcccacgcaattttgcctgctgatcaagatattgctacatatcaacaacaaattgagcaattacggtcaaaaaacctacctagcctgcccgtaaaattgcaatttgagcgcaaaattaatgtttttttacgttgcaatgacattgatttacaaagaaaaataggaataacttcgcctccagactcacttgtctctgttttctgcgaattacgctcccgaaaagacagcttttgagcttttagttgtgttttttatcgaagcaaagtatgattgctcgtcttttaagcaaccacattgacacacacatgaagaccaaagcgatacttctcgcctcagtcttgcttgtcgggtgccagacgtccaagcaggacgcgcaggctcccgaacagcatgcgcagagtttgtcttcggcaggtcaagcgagtgaagcaggagagtacacaaatagcacccgagagggttcagcgcgctggctggaaagtgaaagcagctacgcgcagcaagatttgtggaacttcatcaaagacgagctgaagatgaaggttccggagaattcccggatccgtgaacaaaaacagaaatacttaaaaaataagagctatctccacgatgtaacattacgggcagagccgtacatgtacctgatagtcgagcagattaagaaacgtaagatgccgatggaactggtactgctacccatagtggagagcgcttttgacccacacgcgacatcatccgccaatgccgcagggctatggcagattgtgccaagtacggggcgaaattatggcttgaagcaaaatcaatggtatgacggtcgcagagatgttgttgcctctaccaaagcagcgcttgatatattggaacgcttgaacaaaatgtttaacggtgactggttattgacagtcgcagcttataacagcggtgaaggccgagttatgcaagcgataaaagccaataaggcaaagggcaaaccgaccgatttttgggcattgtcgcttccgcgtgaaacgtcaatttatgttccaaaaatgctggccttgggtgatttactcaagaacagcaaaaagtacggtataaccttgcctgagactgacaaagaccgtgcgctggctcgcgttgatgtcgatcaacaaatagagctaactcaggcagctgagatggcggggatgtcactgacaaagctgaaatcctttaattctggctacaaacgcaatgtaacggcaccggatggacatggtccccgttatattatgttaccgaaagcccatgctgagcagttgaaagactcattggcagatactgatattactgctgttcaacctacaaaattggcaacgaacagtacaaaatcagcatcaagttcgcagtataaagttcgcccaggcgataccttatctacgattgccaagcggttgaatatcaagaccagcgatttgcagagttggaacaacttacgtgccaagagcaccttaaaagttgggcaaaccctgcaactggcaagcaatacaaccagcaaaagtatcacctatcaagttcgtaaaggtgattcctttgccagtattgccaagcgtcacggtgtaaataccgacgatgtgatgcgatggaattcggtagtcagcaaagctaacaatttacaaccaggcttgaaattgacgttattcgttaacgacaaatcaaccccggaggcgtagagccagaatcactgtcaaaaagcacctttcgaggtgctttttttatggttggaattcgacaatgagtgggttgtgatcggaggctctggtcactaaaactgaagcatcaataacggtaaggccgcgataaaaaataaagtccagaggccggccgaacgcacgactgcggtgatcgacgcgaaattcaacctcttgtaaaccagcgtcctgtgcaaagtgctgcaaggcattaatacgttggcggctccaggcattaaaatcacccgcaagaataactgggccacgatgtgaagcaatttgatcaccaatcggatcgagctgtttgctgtaaacatcgacaccaagactgaagtttaccgcatgaatattcaccaccattaacaagcgaccatcatgaataggatagacagtaactaaagccgatttagacaagcgcagtagcggctcacgctcacgcaaagggcaacaatatactggatgagccgcagccagcgtcatcacaccagaagggtgctggggcaatgaaaaagcaggtacctgatctgcggcctgatagctggcagtcgcaaacctcaccaactcaggtgtagtttgtgcttcttgcagtaacatcagttgagtatcacgcccgagttccttaagtacaggtagccatccagcccgctgctgcttaaagatattccacactaccactcgtaaaagttcagctgtaggtaatggttcgcctaacggcaagcctttatcgagttgcttagcggcgccagggaagatctgttcaaccggttgtcctgcaacataccgcattgcatatgttcttttcggcacgcttatcgcctattccttatctaaaatcacactggctcaatagttaatagcagccgggattctattgattatactcccagatatcccggccagtaatatcttttccacaagggattacctagatatagggatactcaacagcatattcaatctatcgcacgcataagctgatgtattaaaaaaaaagcccacaattcaagtcatagactgagaatcaatatctctcctgtattacagcgttagttaacaggaaataatttagtgcactcagtgataacagcccgccctgttcaaggtcattctttcgtaccactttattcatatgactcgcgcccaagttccaccacagccctcgttggtctattgctgatatatcagtccttttctgtagaagacctcttctaataagcatctttgttcgtatatacgaccttttccactgccgccatagcaggcaacgcaattttctttatctccaccgatccaactattccagtcccctcttccacctcggttaaacggaagtaacgtatccatcctctcagtaccgatgctagcctcgcagttaccttgtccagcgctttcgacttgtgacccgttgtcaggccgtaaccctgataattgcagatccatggcctcgttaccgtgttttttaacgatcgagttgtctaccctttgttctcccactcgctgataagcacgcatcagattagtacctactatcaccgcgcacattgacggcggcaactccatgtccatccgcacacttttcaccgagcctgtttcagccccgtcaggatgcaccaaaataaaaaaccacctcaatgtaaggtggctcgtccagtgtcttaggctgctattaatcccatttaggtgctaaaccatcagggctgaccaacctctcattgcgatccaatgtggcgatcaacgccatatctgctgcattcaggcataatttctgtgctagtaagttgctggccaagttagcagctttagtcgatgacggaataacgccataacccaattgcatcgcccaactcaaaataacttgtgcgggggtcgcaccatgttgctcagcaatcgttttaatcactggctctgcaagtgccttgccataagccagtgtcatataggaagtcactgcaatgccattttgtttggcaaaatcaacaacattacggttttgtaataatggagaaagctcgatttgattagttgcaatctcttctgcaccaacggcagcaatcgcctgcttcattaaatcaatagtaaagttagaaataccaatttgacgagttaagcctagcccttttgcttttaataactcggacataaattcagcaacagaaacttcatcattaggtgatggccaatgaatcagtgttaaatctacatagtcagttttcagtttctgtatgctttctcgcaggctgggaattaatttgtcttttgataaattagcaatccagatcttagtagtaataaatagttcatcacgattaataccactttcttggattgcctgaccaacagccgcttcattttcatatatttgtgctgtatcaatcgcccgatagcccaacgtcagagcttggcacactgaatcaataacaatttgatcttgaaggcgaaaagttcctaatccgaatacaggtatgctcataatagttcctcattttttgctaacaatcattttatcttgcgagtcataacgaatttttatcggcagtggaatgttctaaataactaccagatgaaaaactgaatacattatggcaagagttttatcgacaaaaaatggcctattaaacataatacttttgataaaaaatcaataatttcggtaaagttttggctcaaaatgagcgagaataagcctgcttcatagcactaatagctaaagtggactaagagaaaatggataaataggtggataaagaagatagaagatagaagatagaagatagaagatagaagatagaagatagaagatagaagatagaagatagaagatagaagatagaagatagaagatagaagatagagcttactttgttactattttataaatgcaaaaaaccctgaatctaagattcagggttttgcaataagtggcggaacggacggggctcgaacccgcgaccccctgcgtgacaggcaggtattctaaccaactgaactaccgctccaccgattcttttacgtgtatcttcccgatactttaccctataagggccagcgctccgcgctgtgcaaaaccgcttttggcgattttgacagttaccagatgtcactctgataactcgtgtttgatgcctggcagtgtcctactctcgcatggggagcccccacactaccatcggcgctacggcgtttcacttctgagttcggcatgggatcaggtgggaccaccgcgctatggccgccaggcaaattctgtttcaattaacccgcaaacaagcaacacttgtcagccagtcaacacaatctcggaacgacgctgaaaatctctctcaattcaaaacaccttcggtgttgtaaggttaagcctcacggatcattagtactggttagctcaatacatcgctgcacttacacacccagcctatcaacgtcatagtctttaacgttccttcaggggactttaagtcccagggaagactcatctcgaggcaagtttcccgcttagatgctttcagcggttatctcttccgaatttagctaccgggcaatgccattggcatgacaacccgacaccagtattcgtccactcctggtcctctcgtactaggagcagcccctctcaatcttccaacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactaagacctactttcgtacctgctcgagccgtcactctcgcagtcaagctagcttatgcctttgcactaacctcacgatgtccgaccgtgattagctaacacttcgtgctcctccgttactctttgggaggagaccgccccagtcaaactacccaccagacactgtcctcaccccagatcatggggccgagttagaacatcaaacattaaagggtggtatttcaaggttggctccatgcagactggcgtccacacttcaaggcctcccacctatcctacacatcaaggctcaatgttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttactggggcttcgatcaagagcttcgccttgcggctgaccccatcaattaaccttccagcaccgggcaggcgtcacaccgtatacgtccactttcgtgtttgcacagtgctgtgtttttattaaacagttgcagccagctggtatctgcgactggcttcagctccaggagctagtcctttcacctaacgccagcgtgccttctcccgaagttacggcaccattttgcctagttccttcacccgagttctctcaagcgcctgagtattctctacctgaccacctgtgtcggtttggggtacgatttaatgttacctgatgcttagaggcttttcctggaagcatggcatcaactgcttctgcaccgtagtgcatcgtcatcacgcctcagggttgataagcaaccggatttacctggtcactccccctacacgcttaaaccgggacaaccgtcgcccggccagcctagccttctccgtccccccttcgcagtaacaccaagtacaggaatattaacctgtttcccatcgactacgcttttcagcctcgccttaggggtcgactcaccctgccccgattaacgttggacaggaacccttggtcttccggcgtgcgggtttttcacccgcattatcgttacttatgtcagcattcgcacttctgatacctccagcaaccctcacaggtcaccttcaacggcttacagaacgctcccctacccaacaacacctaagtgtcgctgccgcagcttcggtgcatggtttagccccgttacatcttccgcgcaggccgactcgaccagtgagctattacgctttctttaaatgatggctgcttctaagccaacatcctggctgtctgtgccttcccacatcgtttcccacttaaccatgactttgggaccttagctggcggtctgggttgtttccctcttcacgacggacgttagcacccgccgtgtgtctcccgtgataacattcttcggtattcggagtttgcatcggtttggtaagccgggatggccccctagccgaaacagtgctctacccccgaagatgagttcacgaggcgctacctaaatagctttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccttgcaactagacgcccagttaagactcggtttccctacggctcccctattcggttaaccttgctacaaaatataagtcgctgacccattatacaaaaggtacgcagtcacaccacgaaggtgctcccactgcttgtacgtacacggtttcaggttctatttcactcccctcgccggggttcttttcgcctttccctcacggtactggttcactatcggtcagtcaggagtatttagccttggaggatggtccccccatattcagacaggatgtcacgtgtcccgccctactcatcgagttcacagcctgtgcattttggtgtacgggactatcaccctgtaccgtgcgactttccagacgcttccactaacacacaaactgattcagactctgggctcctccccgttcgctcgccgctactgggggaatctcggttgatttcttttcctcggggtacttagatgtttcagttcccccggttcgcctcgttagactatgtattcatctaacgatagtgcaacgtattgcactgggtttccccattcgggtatcgtcggttataacgcttcatatcagcttaccgacgcttttcgcagattagcacgcccttcatcgcctctgactgcctaggcatccaccgtgtacgcttagtcgcttaacctcacaacccgaaggtgtcttgtcattgctgacagtacatcttgtgttgcgattatttgagagactctattacaggttactctttaccccaatacatctacggcggggtaaatttcagctgtaatgtttcaattttcagcttgttccagattgttaaagagcaatatcgtaaacacgacttggtaaagtcatctttacgttatttttcagttcataaagaaccggtgataatgtctttcactcattatcggattggcgtccccaaggggattcgaacccctgttacagccgtgaaagggcagtgtcctaggcctctagacgatggggacacgaaaatgccgatcaaaccgaaattcaaccgtttcgtatcagcatgagtcgaaactcataacatcaacaggtgctcttgctcgtttacattcatcagacaatctgtgtgggcactgcgcaatgcgtatcgttaggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtagcattctgatctacgattactagcgattccgacttcatggagtcgagttgcagactccaatccggactacgacagactttatgtggtccgctggctctcgcgagttcgcttcactttgtatctgccattgtagcacgtgtgtagccctactcgtaagggccatgatgacttgacgtcatccccaccttcctccggtttgtcaccggcagtctcccttgagttcccaccattacgtgctggcaacaaaggataagggttgcgctcgttgcgggacttaacccaacatttcacaacacgagctgacgacagccatgcagcacctgtctcacagttcccgaaggcactttagcatctctgccaaattctgtggatgtcaagagtaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccacgcctcaagggcacaacctccaagtcgacatcgtttacggcgtggactaccagggtatctaatcctgtttgctccccacgctttcgcacctgagcgtcagtctttgtccagggggccgccttcgccaccggtattcctccagatctctacgcatttcaccgctacacctggaattctacccccctctacaagactctagcttgccagtttcaaatgcagttcccacgttaagcgcggggatttcacatctgacttaacaaaccgcctgcgtgcgctttacgcccagtaattccgattaacgcttgcaccctccgtattaccgcggctgctggcacggagttagccggtgcttcttctgcgagtaacgtcaatgattgagcgtattaaactcaaccccttcctcctcgctgaaagtgctttacaacccgaaggccttcttcacacacgcggcatggctgcatcaggcttgcgcccattgtgcaatattccccactgctgcctcccgtaggagtctggaccgtgtctcagttccagtgtggctggtcatcctctcagaccagctagggatcgtcgcctaggtgagccattaccccacctactagctaatcccatctgggttcatccgatggcgtgaggccctaaggtcccccactttgctcttgcgaggtcatgcggtattagctaccgtttccagtagttatccccctccatcaggcagatccccagacattactcacccgtccgccgctcgccggcaaagtagtaaactacttcccgctgccgctcgacttgcatgtgttaggcctgccgccagcgttcaatctgagccatgatcaaactcttcaatttaagatttgtttgatttgctgacttttacttgcgtaaaagcagcggtgctcaaagattactttctgcaaatatgcattctgaccggagtcaaaatgtttactgctttggtcactcttcaagacttgatattatttctgcctgccgaaacaggcgtcgatatcgtcttgcgagtgcccacacagattgtctgataaattgttaaagagcgttcgttacccgtttgccttgcggcgaatcttacggtaacgcgggaggcagataatacgctttcccgctacagagtcaaccacttaatcagttaattttctctgctctccccggccactctgtgaagttgctcacagcgccgtgtcgatggatgcgcattatagggagctgcttcagaatggcaagggtttatcttcacatttttttcgtttgttgattatttgaacgcacaggctatttataacgcgcttttattgcttttggtaggtctgccagactatttagcacccaatcggccgctgcttcaccctcggcagtgactggcttacccgttcgaaccaatactttagtgccaatattcgccgctaatgccgcctgcatatcttcaattttgtcgccaaccatataagaagcagccatatcaatattaagttcattctgcgcttgcaataacattccgggtaatggtttgcggcattcacatgtttcactgaattcagcgacactgccatcaggatgatgtgggcagaaatagatgccatctaaatcaacaccgcgatcagccaatgaccagtccatccattcggttagacttaaaaactgttcttcggtaaacatcccgcgggcgatacccgattgattggttaccaacaccaacgcaaaacccatttctttcaattcacggcatgcatcaataacaccatcgataaattgaaagttgtcaatttcgtggacataaccatgatcgacattaactgtaccatcacgatctaaaaatattgcgggaacggactgagtcacttatatactcctgagggctgtaaaccccgatagtatcgcatgttttattacctattgagaacggaagagaatccacgttgtcagttgacttagccgtctagacgccttaacatccgatccacactttggttctactaaagtccactttttatctagccacggaaataacgataaaataagaataatatgattaaactcacccacatcagcaaagtgttccagcagggttcgcgcactattaccgcgctatcagacgtgagtcttcacgtccctgccgggcaaatttatggcgttatcggcgcttctggcgctggtaaaagtaccctgattcggtgcgctaatatgttagaacggccaaccagcggtcaagttctggttgatggccaagatctgaccactttgtctgaaggccaattaacacgcgcgcgtcgtcagattggcatgatttttcagcactttaatttactctcatcacgcactgtatacggcaatattgcattgcctcttgagttggacaatacatcgcgtgcagatataaagaagagagtgaatgaattactggatttagtagggttgaccgataagcaagatgcttaccccgctaatctgtccggtgggcaaaaacagcgggtcgcaatcgctcgcgcgctggccagtaatcctaaagttttgctgtgtgatgaagccaccagcgcattagacccagccaccacccgctcaatattggagctgctaaaagatattaaccgccgtttggggttaacgattttgcttatcactcatgagatggatgtcgtgaaacgcatctgtgatcaagttgcagtaataagtgaaggcaaactgattgaaaaagacagtgtcagtgaggtgttctctcatcccaagacaccattagcacaacaatttattcaatccaccctgcatttggatattccggaagattacgccaaacgtatgagcccggagccaacggtagatcacgtcccgcttctgaagctggagttcaccggtaagtcagttgatgctccgttaatctcacaagccgtgcgccgcttcaatattgatatcggtatcctaagctcgcagatggattatgccggtggggtgaaattcggtgtcatgttggcagagctacatggcgacgttcaggatggcctggctgccatcaagtttttacaagatcatcatgtgaaagtagaggttctgggttatgtctgaggcaatgatgtggttaatggctcgaggcgtctgggaaactcttatgatgacttttgtttccggtttctttggctttgttctggggctacctgtaggggtgctgttatatgtcacccgtcctgggcaaattatcgctaacaataaaatttatagaacgctgtctggtgtggtgaatattttccgctccattccttttattatcttattggtatggatgattccatttacacgcatgatcgtcggcacatcgattggattgcaggccgctatcgtgccgttaacggtaggagccgcgcctttcattgcccgtatggtggaaaacgctctgctagagattccgtcaggtttggttgaagcggcacgtgcgatgggcgcaacaccgatgcagatcatcaaaaaggtattattaccagaagccctgcccggcttagtgaatgcggcaacgattacattaattactctggtaggctattccgctatgggaggagcagtaggtgccggtggcttaggtcaaatcggttatcagtatggttatattgggtataacgctacggtgatgaatactgtattagtattactagtaattctggtctacctaattcagttaagtggtgatcggatagtcaaagccgttacgcacaaatagtgattaatcagcgactgcctcacacagcggcgcatcttaacgaatgtctatagaggaagggatatgtctttaaaattcaaatctatcgcagcaattagtgcgctgattggtaccttggctttggtgggttgtggcccgactgaaaaagcgccaaaccatattaaagttggcgttattgtcggtgcagagcaacaagttgccgaagtggctcagaaagtggctaaagaaaagtacggtctggacgttgaactggtgacattcaatgactatgtgttaccaaacgaagcactgagcaaaggggatatcgaccttaacgctttccagcataaaccttatctggatcagcaaatcaaagaccgtggctacaaactggtttctgttggcaactcgttcgtttaccccattgccggctattccaagaaaatcaagtcactggatgaactacaacctggatctcaggtcgccctaccaaatgaccctactaatttgggccgttctctgttattgctacaaagcgttggtctgattaagctgaaagacggtgttggcctgctgccaaccgtattagatgtggttgagaaccctaaaaatctgaaactggttgagttggaagcgcctcaattaccacgttctttggatgaccaacaaatcgctctggcgattatcaataccacttacgctagccaaattggcctgacaccagctaaagatggtctgtttgtggaaaataaagaatcaccgtatgtgaatctgattgttgcccgcgaagacaataaagatgcggaaaatgtgaaaaaatttgttcaggcttaccagtctgacgaagtttatgatgcggcgaataaagcattcaacggtggtgcagtaaaaggctggtaatctttaattacctcttttattgaatatatcgacaagacgggctatagcccgtcttgttatttgaataatagattgcttcaatagcacaacttaaatgaataaggctgaggaatttttatgcgtgcgttacctctgtgtctgttagctctgtcgctaactggatgtaccctgcttccatcaaagccatccaccacagataatccgattaagcaaccacctccggttatcgaacgcagccccacggcagccccacggcctgcaccggtaaagctttataaaagtgccgaagaacttgttggtaagccttttcgcgatctaggtgaagtgtctggtgaatcttgccaatcaaccgttcaggattctccacccagtatttcaaccgctcgtaagagaatgcaaattcgtgcatcttatatgaaagcaaatgccgtcttactgcatgaatgtgaaatacaaagtggtgtccctggctgctatcaacaagcggtgtgtcagggttcagcactgaacgtttcatctaaatgagtacattctcttttaatcagatcggcgtgatccgttcaccgtataaagaaaagtttgcggtaccacggcaacccggtttggttgaggatggtggtggcgaattacagttgctggcaccttacaaccaaccagaaagcgtacgcggcttatctgacttcagccatttatgggtgatattcgttttccatcagacgatggagggtggctggcgtccaactgttcgccctccccgtctggggggaaatacacgaatgggcgtatttgcgacccgttcaacttttcgtccaaacccgataggcatgtcgctgattgagttgaaaggcgttcgttgccaaaacggtgaggtgattctggcattgggcagcctggatttagttgatggcacgcctgttattgatattaaaccttatctgcctttcgctgagagccaacctcaggcgcgcgctggttttgcgcaatctgcaccagatacagagatgcaagtttgcttttctcccgccgccgagcaacagttagctcaccaccagcagcgttatccacatcttcgccgttttatcagccaagttttagcacaagatccacgcccagcttaccgtaaagacgataatgaaagccgtgaatatgccgttttattactggaatttaatgtgcgctggcgggttattggccagcaaacagaagtgttatcactcgacccacgctaaatttcactctgctctcttttgacaacccgtgctcactggtaaactaggccactttttactttttggctgcccctaattgcagtgctaatggaacaaaaacatcatgcgtactagccaatatctgctctccactcagaaagagacacctgccgatgctgaagttatcagccatcaactcatgctccgtgccgggatgatccgcaaactggcctcaggtctttacacctggctaccgaccggggttcgggtgttgaaaaaagttgaaaacatcgtgcgcgaagaaatgaataacgcaggtgctatcgaagtatcaatgccagtggtacaacccgcggacttatggcaagagagtggccgctgggagcagtacggccctgagttgttgcgttttgttgaccgcggcgagcgcccttttgttcttggcccaacccatgaagaagtgattactgatctgatccgcggcgagattaactcttacaaacaactgccgctgaatttcttccaaattcagaccaagtttcgtgatgaattgcgcccgcgctttggtgtcatgcgcgcccgtgagtttttgatgaaagatgcgtattccttccatactacgcaagagtctttacaggaaacttacgacgcgatgtataccgcgtacagtaagattttcagccggatggatttgaacttccgtgcggtactggcggataccggctctatcggcggcagtgcatcccacgaattccaagtgctggcagaaagtggcgaagatgatatcgttttctccactggctctgattacgcagccaatattgaattcgctgaagcattagcgccaactgaaccacgcgcaccggctacagaagagctgcgaatcgttgacaccccgaacgcaaaaaccatcgccgagttggtagagcaattcaaactccccattgagaaaaccgtgaaaaccttattggttcatgctcacgaagagagtggtcataagttggttgcgctcctggtgcgcggcgatcatgatttaaatgagatcaaagcagagaagctgccacaagttgccaagccactgacctttgctagcgaagaggaaattcgtgcagctatcggcgctggcccaggttcattaggcccggttaatttatcattgcctgttattgctgaccgcagtgtggcggtgatgagcgatttcggtgcgggtgcgaatattgatgggaagcattactttggtattaactgggagcgtgatttggcgctgccgctcgttgctgatttgcgtaacgtagtagaaggcgatatcagccctgatggcaaaggcactctacagatcaaacgcggtattgaagtgggccatattttccagttagggaccaaatattctgaagccatgaaagccaccgttcagggcgaagatggccgtaatcaggtgatgaccatgggttgctacggcataggggtatcccgtgtggtggcggcggctattgagcagaaccatgatgaccgcggtatcatctggccagatgctattgcgccattccaggttgctattctacctatgaatatgcacaaatctttccgagtgaaagaactggcagaagagctctacaccaccctgcgttctcacggtattgacgttattctcgacgaccgtaaagagcgcccaggtgtgatgtttgccgatatggaattgattggcgtgccacacaatatcgtcattggtgaccgtaatctcgatagcgaagaagtggaatacaaaaaccgacgcgtcggtgaaaaacaaatgattaagaccagcgaaattgttgagttcttgctgagccaaataaaacgctgaatggctatatacccgtcataaataaagatacccgccataaataaagagtccccataagcggggtattttactgatgaagccgccggagaacttgaactgccgtgcggcttcttattttagctatggacaagggctattttttctcacaacttttattggcattaaactgaatatccccctccggaatcagcgttttattcgttcgcccttcttccattgatggccttgaatcaaaatacccattgagggtcaaaaacacaggttctccagggtttctgcgagcgtttaaatacccggtttccagttcgatattattctctaccgggaacgccttacccgttacacaatcagtaaatatggcggcatcagcaaagtatttatacataccacttagtggcattggcgttttggataacggctggtcgctgggttccaactgataattcagtgtcgatttaatgggtaaaccttgctgatcgagcatcaccaagcttttatcgacagggtggaagtaacgtttttctccctgaccgttggttaacactaacttatcagcagtacgtgcccatttaccatattctgcaaaagtttggtcgccatctttagtgccgagataaacttctttcaagataaaagtcccatcactatcgaggaacaaagaagtgtctaagccactgcaatccgcacaaggtaatacgccctgatagctctgctgcattggttgcaaaacctgttcagcaggttgagagcgattattacagcctaataatgacagcgcacctactgccaaaagtagcgttatcgttaatttactcacagtgattctcccatactgtgtccgatatatatggaatgaagtcatatcaaccgcaatgtatcaacgttcatatgaatatcgacttcactcttgatgtattttaccacgcagcgcttttgtcgcccctttgcggactttaccctcaactcgcctgatttttgaacctttggttggttttgtcgctcgacgggccttttctaccaccattgcctggcgaatgagtgctaccaagcgcgccaatgcagcctcacggttcatatcttggctgcggtattcctgtgcttttatgatgacaacaccttcagctgtcaccaaatggctatttagcaacaataacctttctttataatactctggcaggcttgaggccttaatgtcaaagcgcaaatgaatcgcagttgaggttttattaacatgctggcctccagcgccctgcgcccggatcgcggtcagctcaatctcgccgctggctagcgtgacactattagagataatcaacacacttattgcccgtagttttgccattcggcaaaactaatttccagattattctgtacatctgatagccagatagtcccttcttgcagtgtcgcctgtaatgacatattgcggttagacagcgcagccaacttcgccatttgttcgtcatcaagaaaacgcactcttaagttacgatgcccagcgagtttctcctgaacttgtggccaccagactttggccgcacgctcactgtatgcatacagaacgacttgttttgattgattacaggctttgcgcaaccgtttctcttcaggtagccccaattcaatccacagctcaatgccgttgtggtcattatggcgccaaacttcgggttcatcatcagcactgagtcctttggtaaacagcaagcgctcatcagcatggcaaatccatgccagtaaacgcagcatcatacgttgatccgtttccgagggatgttgcgctatcgtcaggttaatatcctggaaaaaattacggtccatatctgcaatgttaatagcggctttatggatagttgcttttagtgccatgggtgacctctgaattatctggctaacagtgtacttgattagacctgccagcagacagcgaaccatacagaaagaaggatataagtggtatcaataccaaaaataaaccttagcttgcactctaatatctctacaactcctgtgctatagtccttataagttcagagtttatcttcgtaggtttacagtttgtcttttctgctgagagcttaccgggttaaacttttccgggaggattattgtgcagcaatactgtgaattagtacgccgtttttatgccgagattggaagtggtgatcttggctacgtgccagacgcactacgctgtgtattgaaagcattggacgaagttgcggctaacgacgcactcccgtcctccgttagggaacaggcggcctatgccgccgctaacttattggtgagcgattatgtcgatgagtgaagagtatcaacccatcaattgtgatgactacgataatctggaactcgcctgccaacatcacctgatactgacgttgaagttgagaggcggtgagatcgtagaaggcaaagccagcgatctgctgctgagaaaaaaggtcgagtacctgattgtcgagcaagaagggacaatgcgcgaattgcgtctggaccatatcgccagcttcagtcaccccgaaattggaacggtcgtagtgagcgcatcatagtttccacttccttgtgaaaaacgggtcgctgaagagcggcccgttttgcatttatcctatttacatttacctggcttacattttacccgaccctacgtacttgacgtgactactgtactgacggctttcgtgactactctgcctatccttacacttcgcctctacaaggtcgctgtaagccgcgttaaaatcagctcccggcagatttatcacccgattcactgactggcttgttttattatccacatataatttatggctttaggctggcataatacgcagccaaatcagaaaaatcttcatcggataaaccggatacataagcgcgcatcacctcggcttgcccgccggagcggctcccctttttataggcttctaatgattgttgcagatacagcgcattctgcccggccaggttaggatacataggtactgaaactttaccattcatgccatggcaggccacacaactggatgacttagcacgccccgcctcaatatcattttttgcccacacctgaaagctacacaagctcagtaacaccgccatactgacaactaatttcatcattattgctcctcaaaaattaacgggactcttccagacaacggacaaaccctcaatgactcgtttttaaacgcgtgaggatagactgcccgcaccacagatggcactgttctaacccacatggaagttattttcatgcggggaatctggcgtttttacgatctatttattctctccggtgtgggcattgagtcatcaacctcgactctctcttcttctttttcaatgcgggtgttggtttatcccaatttaagtggcttatcccaatctaagtgccagcatggctcattttcattcgcctgccccgcttgggtaacgaatacccccgcggctgcaattaattgttcaccgaaatataacagcggaatacgttcccgctgccatgggggaatacccagctcttgccatacttttttactttgacgcgagtgatgccgcccaacaattttgatatctccctgtaaaccaaaacgtacacttatctcctcgccaacggcggcaggacggaccgcttgcccacccgctgagacaaacctcagtacgcctaaatcggcaggtagccataatggctcgggtaataaaggtattatcgacgaatttggggcggccttaacggttgcccaaggtaagtaatttgttgttatttcagccaagggcattaataaatacagatgttgacgaaaacggcgtacctgacgggtgccaatcattaattgaggctccgcatcttgccgtgccatggcgacctccagccacaggcgctgcaattggctttgtgatggcattggtgcaccaagactcgccaaccagcggcgcaatatagccgcccgtttcgccattgatgcctgtaatagtccatcaatagagagtgatctgtcaggtccctgtaactgctgcaagttttcagccaacagttcatccaataactgctcctgctcagcacatagccccgcactacgtgccgtggcctgagcaaaatgtggccaacgttgattaagtatcggcagaacatttagccgtaagaaattgcgatcaaaacgatcatcttgattgctatcatcttcaatccattgtaattgctgtgcctgtgcatagttctctaatatctctcgagaaaaagcgagtagtggccgcaacagttggctgtgggcaaagggcattttagccgccatcgcagagagacccgccggcccgctaccacgcttaagtgccaacaggaaggtctcacattgatcgtccaaatgctgggcggtcagtaagacttctttggcagccaaattggcggaaaaggcttggtaacgtgctgttctggctgccgcttctatcccgttctgccgaggatcaatattaactcgcaccaccttaagctcaattttccattgatcacattgctgcatacaatgttttacccaactatcagcctgcgggtttaaaccatggtgaatatgaatagcgcgaatgttcagttcaggaataagttgttgacgtaaacagaccaataaatgcagtaacaccgtggaatctaacccaccactaaaccccaccaacacatgacggttttcacccagttgagcgaaaagagggttaagtaacacattgggtttcgaggtgactaagttcatgtcattccgctttcaattcatatagctccagtggtaaaccatctgggtcattaaagaaagtaaaacgtgattgagtgtagggatcaatgcgaactgcttcgcaaacaacgcccgcgacgacaagttcttttagcgccagatcaatatcatcaacctggaaagccagatgacgtaaaccacaggcctctggacgacttgggcgcggtaccggtgaaggaaaggagaataattcaatggtgtattggtcatgtaacgccagatccgctttccatgaatcacgctcttcgcgataaacctcgctgatcagattaaaacctagcacctcacagtagaaccgtttactggcctgataatctgagcaaataatcgcaatatggtgaatcttattaattgccagcacgtatcctccgttaaattaaacatgttacatctgccagactttaagttgcctgtgtgttggccccctgcatctcgaagtaacttgggtatagattgcttaactaaattcgggtcttcagtaaaaaatagataaaaaaaaccggcgcttaaattccgcaccggcttttatcagttggcaatcaactcagcaatagccgtagttcatcaagcgctgataacgacgattcaataactcttcgtcattcagcacatccaaatcattgagatctgccaacagttgcgctttcagtgagatagcaatcgcggcgtaatcgcgatgtgcgccccccaacggctcggggatcactgagtcaatcatcttcagttcttttaggcgatgtgcagtaatgcccatcgcttctgcggctaatggcgctttatccgcacttttccacagaatagaggcgcaaccttctggagagataacagaataagtgctgtattgcagcatattcactttatcacccacaccgatagccaacgcaccaccagatccaccttcaccaatcacggtacagacgatagggacattcagtcgtgacatttcacgcaagttgcgcgcaatcgcttctgattgaccacgttcttccgccccaacacccggataagcccccggtgtatcgatgaaagtaataatgggtaacttaaagcgttcagccatttccatcagacgtaaagctttacgatacccttctggtgctggcataccaaagttacgacggatcttctctttggtttcacgccctttttgatgaccaataatcatcaccgggcgcccatccagacgtgcaataccgccaacaatagctttatcatcggcataagcacgatcaccagccagctcttcgaaatcggtaaagatattagcgatataatccagggtataaggacgacgaggatggcgtgccaattgggcaatctgccatgcgccgaggtccgagaaaattttccgcgtcagctcaacacttttctcacgcagacgctggacctcttcatccagattaatatctaatttttcgtcttgacggctgactgcagtcagcgagtcaattttcgcttccagctctgcaatcggctgttcaaaatcaagaaaattcagactcatagcattcctattttagtcaaattccagttccacttgctcattacctaccaacgttcgcaaatcgattaataagcgatcggtgggcgtcacgcgccatgtggctccaaaccgcagccgggcgcgagcatcttcccgttggtaataaagatgtactgggatcgtccccgctcgatggggttccaacgactgacggagacggttcaaaagctggtcatcaatttgcctgtcagtcagcgagatagcaagcccacgggcatatttttcacgagcttcactgatgtccattaactcacgggcggtcattttaagcccaccactaaagtcatcaaagctgacctgtccggtggctatcaggatacggtctttttccaataaatgctgatatttttccaatgcatcggtgaataacatcacctccagacgaccagagcggtcatctagcgtacaaataccaatgcgattaccacgttttgtgaccataacccttgccgcgatcaccaaccccactgcggtggtcattttgccccgatccgtcggatgcatatccttcaaacgcatcccaccggcatagcgttcgatttccttgaggtactgagtgatcggatggccagttaaatacagccccagcgtttcccgttcaccatctaaaacaacctgctcctgccatggcggcacattggcataggattgctcaacctgctcaggcgcgtcggctaatacaccaaacatatctacctgaccaattgcttcggctttagcatgttgatctgcggctttaagcgcatccccgagagaactcatcaatgctgcacggtgtggccccaaacggtcaaatgcaccggacatgatcagtttttctaaaatacgcttgttaagctttttggtatcgacacgggcgcataggtcaaataactctttaaaatagcccccctctttacgcgcctccagaatggcttctatcggcccctcacctacacctttaatggcaccaataccataaacaatttcgccatcatcgtttacatggaaatggtacaaaccgctgttgatgtcagggggcagaattttcagccccatacgccagcattcatcgaccaagccgaccactttgtccgtattatccatatcagcggtcattactgcagccataaattcagccggataatgggcttttaaccacaacgtttgataggagactaatgcataagctgccgagtgagatttgttaaaaccgtaacctgcaaatttctcaaccaggtcaaagattttaatcgccagctcaccatcaataccctgatttttcgcaccatcttcaaatacagaacgctgcttagccatctcagcagggtttttcttacccatggcacgacgcaacatgtccgcaccacccagtgagtagccggacagaacctgcgcaatttgcatgacctgttcctgatacaagataatgccgtaggtcggctcaagcacaggtttcaaggattcatgttgccactcaatatctgggtaagatatcgcttcccggccgtgtttacggtcaataaagttatcaaccatccctgattgtaacggaccgggacgaaataacgccactaaggcgatcatgtcctcgaagcagtcgggcttcaggcgcttgatcaagtctttcatccctctggattccagctggaatactgctgtcgtttccgaacgttgcagcatatcgaagctttttttatcctccagcggaatagaggcgatatcaatgggttccaatccagttttagcgcgccgggcgttaatcatctccaacgcccaattaatgatggttagtgtacgtagaccgaggaagtcaaacttcaccagcccagcatattccacatcatttttatcaaactgcgtaactgggttattgccttccgcatcacaatagagtggggcaaaatcggtaatcttagtgggggcaataaccacgcctccagcatgtttcccggcgtttcgcgttactccttccagcttacgcgccatatcaattagcgccctgacctcttcatcagcttcataaatttcagctagctgtggctccgctgcaaacgctttttccagtgtcatccccggatcgagtgggattaattttgagatccgatcaacaaagccatagggatggcctaatacacggccgacatcgcggatgaccgctttagccgccatggtaccgaaggtaattatctgggaaaccgcatcgcggccatacatttccgccacgtgttcgatcaccagatcacgtttctccatacagaagtcaacgtcgaagtcaggcatcgatacacgttccggattaaggaagcgctcgaacagtagatcaaattccagtgggtcaatatcagtaattttcagggcataagccaccaatgagcctgcaccagagccacgccccggccccaccggtacgccgttatctttcgaccactggataaactccattacaatcaggaagtaaccagggaagcccatttggttgataactttgagctcgatatccagacgttcatcatattctggccgtttttgcagcctaacctcagggtccggaaacagaaattccaaacgttcttccaaaccttgtttggctttttctaccagaaaatcttctgtactcatctcccctgtggggaactgcggtaagaaatattccccaaggcgaatagtgacattacagcgtttggctatctcaacgctgttgatcaacgcttctggaatatcagcgaacagctcacacatctgttcttcatcgcgcataaactgctgagggctgtaattcttcggccgtttaggatcgaccaatgtaaaaccatcatggatagcgacacggatttcatgggcatcaaaatccgattcatcaataaaacgcacatcattggtcgcaacgacaggtaaaccacgctcagtggccaatgccacggcagcatgaagatagttttcttcgtctggacgcccggttcgaataagttcgaggtaatagcagtctggaaagtgttcctgataaaaggcgagacattgatcaacctgaacctggttaccccgtagcagaaatttgcccacatcccccattcggccaccagacagcagaatgagtccttctttatgtttgatcagccaatcgcgatcaatgataggacccgcagcgccataaccccgttggtaggcttctgagatcaataaagtcagattttgatagccttcattattgcgagccaaaaccgtgaggtgagctaattcatcacccagtatttcactttgtacgtagaagtcagcaccgatgatgggtttaatccccgcaccatgcgcgctgccgtagaatttcaccaggccacagaggttagtaaaatcggtaatagccagagcaggcatacctaatgcagcagctcttttcaccaaaggtccaatcttagctaatccatcgatcatggaataatcgctatgaacacgcaggtggacaaaacgaggttcggccatatccagataccagaaatgagtggattgaatcatacgccccggtagctaagtacccggaacatcatagctatccccatcatatttcaagttgcctatgtattggctatcttcgtgcaactcaaattatttagggtatatatatcatcgatgcaagcttatcgtttacaccaaacccagcacccgtttcaccgggccaaaactgcgccgatgatgtaccgtggcaccaagcgcggctaacttttccaaatgaaaagccgttgggtagcctttatgttgtgcgaaaccatattcagggaagaggaggtccaactcggtcatttcacgatcacgcgtcactttggctaaaatagaagccgcgctgatctccgccacccggctatctcctttgacaacggccagtgacggcatctgtaatttcgggcaacggttaccatctatcaatacataatcgggtacaatatgcagccccgatacagccctttgcatcgccagcatggttgcgtgcaaaatattaagctgatcaatttcttccggttcagcacgaccaagactccatgatagtgccttttcagtgatttcgtcatacagtgacaggcggcgcttctcgctgagtttttttgaatctgccaagccaactattggccggttaggatcaaggatcaccgctgcagtgactacggcacccaccaaagggccacgacccacttcatccacgcctgcgattaaattagcctgtgggtaaataaaagtctcgctcatcgatctgccagctccaatacagcttgtgctgcctgttcatccgcaccacagcggatgctctgatgcagaaccaaaaaacgttcttttaaggctgctatttcgctaccaccttgtagcaacggcaaaagtgcaccagcgagtttttgcggctggcactcttgttgcaacaattctgtcaccaactcttcccctgctaacagattcggtaatgaaacataaggtgttttgactaatcgctctgccaaccagaaagtaaatggcttcatacgataccccacaaccatcgggcatttggccagcatacattcgagtgcagccgtgcctgaggctaacaatgctgcatcactggcgatcatcgcgacacgcgctttaccatccagtaaatgtacggataaatcaggcgcaatttccgctttaattcgctcgaattgttcacgtcgcttgctgttgaccaagggaaccactacttccaaattgggcaatttatcacgcagaattaccgctgtacgtaaaaaatcagcgctgagcatttcaacttcagagtggcggctacccggtaacagcgccagacaagtggcattaggcgcaatgccaagctctgctctcgctgcctgctgatcgggtactagtggcatggcatcggccatggtatggcctataaaacggcaagggacattgaaacgatcataaaacgctttttcaaaagggagaaaagccaacaccatgtcggtcgcttttccaattttgaaaacacgtttttgtcgccaggcccagactgatgggctgacataatgaatagtccgaataccccgttgttttaagcgcccttcaagggtgatgttgaaatcgggggcgtcaatgccaacaaagacatcgggagaaagctcactaaaacgctgagtcagatccttcctgattttcaataaccgtggcaggcgctctaatacttcaacaacgcccatgacggctaactcttccatctcataccaggcttcacacccttcggcttgcatcagaggcccagcgacaccgacaaatcgggcattgggtacctgaactttcagcgcccgaattaatccagcgcctaagatatcgccggaagtttctccggcaactaaaccaatcgttaggggacgtccagcgtttaatgaacaatcagcagtcaatgggctattttgcataagtcagcgaataataccgcgggtcgaacgagcaaagaaatcattgaacgctttaacgactggatattgctccgctaattcagcaatttctggtttcacttcatccaacgtcctgccactgcggtacaacaacttgtatgcactacggatagcatgaagagattctttgtcgaaaccacgacgtttcaaaccttcaatattaatcccaaatggcgtcgcatgattcccttgagcgatgacaaaaggaggcacatcctgagtaataccggaacaaccgccgaccatcacatgcgcaccaatcacacaaaattgatggatagccgtcatgccaccgataatagcgtaatcgtcaatctctacatgcccccccaacgctgcattattagcaagaatgcaacggttaccaatgacacaatcatgggcaacatgggtattaaccatcagtagattgtcgcaaccgaccttggtcacccccccaccttgtgtggtacctcggtggatagtgacactttcacgtatacggttacgatcaccgacctcaacccgagtaggctcacctgcatatttcagatcttggttcgcttcaccgatggaagcaaactggtaaatttgattatcacagccgatcttggttatgccattaacgacaacgtgggatttcagttccgtgccagcaccaatttccacctgggatccgacaatgcagaagggcccaatataaacaccagcgccaatgatggcaccttcttcaacgatagaacttggatggataaaggcggttttgtcaatcacgaatcaggactccttaacgacaggatttacaacatctggttttacaacatctggttttacaacgacagattctgcaggtgctgctggtttgctacgcgcgcacatcatggtggcagtgcaaacgatttcgccatcgactttagctacaccggtaaaacgggttaggccacggcgttctttaacaaactcaacttccatgatcatctgatcgccaggcactactgggcgcttaaaacgtgcttcatcaataccagcaaagtaataaagctcgcccggttccagtttaccgcggctcttaaacgccaaaatccctgtagcctgcgccatcgcttctaatataagcacaccagggaagatgggcttgcctgggaaatggccttggaaaaatggctcgttaaaagagacgttcttcactgcacgcagaaattttccttcctcaaaatcaaggacacggtctaccagcaagaacggaaaacggtgcgggagtagatccaaaatctcttcaatatgcagagtatgagtgtcagtagtcaaaatactcttcctgtctaaaaaactgatgctatcaacaacacggcctgcacagccccaaagggaggcattaggcaggccgcaaattaggaactctgtagacttttggcatcactgccagtaagttcgattattaactcagagtgtcaggctagagtgattattctttatcgattttacgctcaacagcttttaagcgtttattaataccatcaatattcatcactagagcggcagttttgcgccacattttatttggttgtaacggaataccggaggagtataacccaggttcagtgattggtctcatcaccattcccatcccggtaattgttactttgtcacaaatttccatatggccattaatcacactggcaccgccaatcatacaatagcggcccactttcaaactgccagccatgataacaccaccggcaactgccgtattgtcgccaatcacaacgttatgtgcaatctgacattggttatcaatgatgacaccgttaccaataatcgtgttatccagcgcaccacggtcaatcgttgtacaggcaccaatctcaacacggtcgccaatatgtacagaaccaagctgcggtatttttacccagttaccacgatcatttgcataaccaaagccatcggcaccaatgacagtaccagattggatcaggcaattctgcccaataacaacttcatgatagatagaaacattagcccacaaacggctacccgcaccaatatgggtgttcttaccaatgaagcaacccgcaccgatgacaacattatcgccgagtacaacacccgactctatgactgcattcgcaccaacagaaaccccctcgcccaacgttgcctgcggagaaatcacggcactcggtgcgatatcctgagcaggttgaggggtggtatccattatttgagccatgcgcgcataggtgaaataaggattttcaacaactaaagcagcaactttacaaaaaggtaaatcagcctcagtcaataccacagcacctgcattgcaagatgcaagttgttcccgatagcggctgtttgacaaaaacgtgatttgctcaggttgggcagaatgcatagaagcgatgccggtgatgacaagatcgccatcaccgtgcacctgtgcatccaactgctgggctaaatcagccagtcgaattgaaggcatgttttatttaacctgtttcaatacgtcagcagtaatgtctttagaagaatcagcgtatgccactgcattcgcatcaatgactacgtcatagccacctttggtagcaacagatttaacagcatcctgaatacggctcaggattttgttacgctcttctgcctgacgacggcggttatcttgctcaaaagcctgcgctttagtagagaaagtttcacgctgtttcattacttcattttccagcttggtacgatcactggctttcatggtagaaccatcacgttgtagcttctgcattttagtctgcagatcgcgctccattccttgcagttcggttgcacggcctttgaattcattctccagctgcttagccacggcttcacgcgcgggtaattgttggaaaatgctggaaacattaacaatagcaattttgtcagctgcttgaacgctggctgaagcagccaatgctaaacctagacttgcggcacacaaccactttttcactataaactccttaccattacccgtttgtgtcagagacaccttgaattgcacttggtagtgtatcccacctgatgaagcgtcagatttcaccaacgcgacttaagatcctttcactaccagtgctgtctttaaaattcagaactgctttgcccatcaattaccaagttttaccaatgttaaactggaattgctctgacttatcaccttcgtaatctttaactggtttagcatatgagaacaccaatggacccaatggagacatccattgcaatgctacacccgcagacacacgaatattactcgctttaccgtaatcaggaatacctgcagcacgcgttttagctgtgttttcccaattggtatcccacacagtacctgagtcgataaagatggaggtacgcactgaattcgagtatttctcgctgataaacggtgtcggtgtgatcaactcgatactggccaccgccatcgcattaccccctaccgcatcggtagagttagtcactgtagccccaccattagcgtaatacgccgcttttggaccaatgttattcgaccggaaaccacgaaccgtgctggaaccacctgcatagaagttttcgtagaatggcatctctttcgaaccaataccgtcaccataacctaagcgaccacggcctaagagcacccacgaacgatcttcatttaatggctggtaagctgatgtatcgaaagtcactttgtagaactcattatctgagcctggcacggtaattttcgtgttcaccgatgatttaacccccgatgttgggaagaaaccacggtcaaggttgttatatgtccaccctagattcagagtgaagtcatcagtagtgaaaccttcacgtccatcatagcccgggcgctcacccactgattcaagataacgccacatcgcaacttgcggtaacatgtcagacagatcgttatggacataaccgacaccaacacgtaatgagttattctcattaattgggaagccaagagtaccgtcggcaccatagctactgttggtatagccagataaatctgcattatccgctttaaagtcattgtagaaaatacgcccacccagacttacaccatcaacagtgaagtaagggtccattagcgtaaattctgcatacgtctgataatcgttctttgtgccgttaatacccacggtattaccggtgcctagccagttatcttgctgaacgccaacctggaaactcaccccgctctcggtaccataaccaataccaaagttcaggctgcccgtgtttcgttctttcactttataggtcacatcaaccagatcggcagctcccggtacacgttgagtctcaacatcaacggtctcgaagtaacccaaacggttaagtcgctctttacccgcttctacctgatcattgcccaaccatgcaccttccatctggcgcatttcacggcgcaacaccgagtctttactggtatcgttaccttcgaaacgaatatggcggacatagaaacggttacctgcatccacgttgatatgcagtttaactgttttatcgtcatcattaatttctggctgagtgacaacacgtgggtaagcatagccgtaacggcccaacatctttttgatgtcatcttccatacgtgtcactttactgccgttaaacaactcacccggctcaatttttgtcagcttctcagcttcagattgatgccctgcaagattgccgctcacaatcacactatttagcttgaattgtgggccttcagtaatattgatggtgacatagatgccttttttatctggcgtcaaactcacctgagttgaatcgatattaaagcgcgcataaccgcggtctaaatagaagctgcgcaaggtttcaaggtcacctgccagtttctgtttctgatatttacgatcaccgactacgttccaccaaggcacctcgtcacgcagttggaagcgtgagataagctcatcagtggtgaaactgtgattacctacgatattaatctgctgaatttttgcagaaacaccttcggtaaagaccaatttcaggtcaacacgattacgtggtaatggcgtaacaacagccttcactgaagcgctgtatttacccacactgtaatagaaatcttcgagtcctttttcaatgttggatatagtggttcggtccaaggcctcgccaacccggacgccagaggcttccagattctgcttgagcatatcttctttcaccgctttattaccggagaaagtgatgctggcaatcgtggggcgttctttgacttgaacaatcagcgtattaccatcgcgcaggacgcgaacgtcctcgaagttgcctgtagcaaacaacgcacggatagttttaccgatgtcatcatcactgacggtatcgcctacgcgaaccggcatattaagtaacgccgcaccgacggcgacccgttgcagtccttcgaaatgaatatcgttcactacgaacccgtctgcaccgtatacggtggcgctgccaaacagcagcgacgctatgagcaactttttcatcgccatcgttgttatgcgttcttcctaacctatcccctgccgttaaagacgggagaaatcattgaaaagtgcaagccccattaatagcaccagcaaaatcgagccgatgcgataactgaagtcctgcactcgctcagaaaccggcccacccttcagcttttctatcgccaggaagagcagatgtccaccatctaatactggtaatgggaacaaattgataatgcccaagttgacgctgattagcgccaaaaacatcaggtagtacaccaatccgtactcagctgaaagcccagcgccttgcgcaatagatatcgggccacttaggttattcagcttaacatcaccagtaatcagtttacccaacatgcttaccgtcaaccgcatcaactgccaggttttatccccagcttgatagactgccgtaaacggcccatattggcgaattgttttatattcatccggaagtggtatcactttcggcactacacccgcaaaaccttcactacggttttctccaaccgattttgtatctggtatcaaggttaaagacaagggggtactctccctttcaatatctaataccagcggctggccgggattatcacggacctgtaacacaaatgtctgccaacgatccaataattgaccattaactttaacgatcctatcccctgcttgtaaacccgccttttgtgccgctgaccctggctgaacttcagccaagacagattcaatctgcggaccacgtgggataataccgagtgctacaactggatcttgtttatcgggttcaaattgccactggcgtaaatccagagttttctctaccacattgtcggaaccaaatggagcgacccccacttgcatttgcttatcgccaattcggctgatcaacgccaaacgaacagaatcccaatcaggcgtttcgatgccatcaacagacttaagttccattcctgaagaaatattggcttgtgcagcaatagattgtggcgaaatatcaccaatgaccggacggacacttggcacgccgatgataaacaccagccagtaagcgacgatggcaaaaaggaagttagcaataggacccgcgctgacgattgccgcacgttgtaaaacagttttattgttgaatgattgatggcgtaattctggcgcaacagcctctacacgctcatctaacattttaacgtaaccgcccagtgggataagggcgataacatactcggttccctgacgatcagtacggcgccataacgctttaccaaaaccaattgaaaaacgctctacacggacaccacagcgccgtgccacccaaaagtgaccaaactcatgcactgtaattaagatccccagtgcgacaataaacgcagccaggctccagagtatgctcatcataatccctaaactccccgtcagtgacggattaaaacactaacagcattaagcaggcaaataccggcacagctgcggtcaggctatcgatacgatccagtatcccaccatgaccaggaatcaaatgaccactgtctttgattcccgcttcacgtttaaacatactttcagtcagatcaccgagtaccgaggccaatgcagcaaccacggaacagattaacagtttttcggggacgatatccaacggtgcgtatcgaccaaacagcaatgatatcagagctgacgtcagtaaaccgccaattaatccttcccatgttttacctggtgagactttaggcgctaatttgtgtttaccgaacaatttaccaaacatgtaggcgccagaatctgccccccacactaataacatgacatataacagccaccaagcgccggtattatggttctgctcgtagccatactggcgtaaagcaaacattccccaaaaaaatgggataatagtcagaataccgaagatgatgcgcaggaggcgcgagttacgccaagatacagcagagcgcgggtaagtaagcaccagcatcaatgcagcaacccaccagcccatagagagccatagtggtgtactcaccaagaggtgatgaggtgaatgctgatattcagggagactaagcagcatggcaacaagcaggaatccgcacagtatcgctaaccagatacgctgagtacgactggtaaaacccgctaattgaccccattcccaggctgcaagcatgcagacgacgagagtaacaatagcgaaaccaaccggcggaagcaggaacagtgcaccaatgacaaccggaatcaaaatcaaagcagttatgagacgatacttcagcaaaagttccccctaggatgcagtggcatcgataggtgtagttcccccgaagcgacgctcgcgttgtgcaaatgcattcagcgcaccttcaaagacattttcatcaaaatcaggccagaggacatctgtaaagtaaagttcagcataggctatttgccacaacaagaaattactgatgcgatgttcaccaccggttctgatcactaagtccacctgagattgctcatgcaggcagatatacgagttgagcgactcttcactgatatctgtaggttgcaattcccctttctgaacttgttcagctaaatggcgcaccccctggatgatatcccaacggccaccataattggcagcaatgttgagtttcaatccgtcattatttgccgttaatttttctgaacgacgaattcgctcttgtaaacgcccactaaaacggctgatatcaccaataatagataaacgaacattatgtttatgcaagctttttacttcactgtctagtgctcgaacaaaaagctccatcagagcggtcacttcttggtcagggcgattccagttttcactgctaaaagcataaagagtgagcgcatctaaattatgcttcgcagcaaaactcactgcgcgtcgaacggacttcaccccggctttatggccgaaaactcttaatttacccttatttttagcccaacgtccattaccatccataatgatagcaacatgacgtggactccggggggacaagttagccctatcttcttttacaggcgacataacgcgaacttatttcctcaataaatcagttgttcgtcccgaacattaggcctcaagtgcacaaaaaaagccgtgtaccaagtcacggcttctggagtgacagcccaaatagacggtttaaatacctattgggtcactaatcaacagtctatctatccattgatagggttgactataccatctcagcctttccctaacaaatgaccggatcagcgaacctggtttaattatttaattttgcaatgacttgggccgcgacatcacgagctttgcgatcaatcaccaacacctcttccacactggtaggttctgataataataaaccttcaacaacagtacggttaatcacttcaatatcagtgaaacgaatttttgaatctaaaaatgccatgactgaaatttcatttgctgcattcagcgctgttgtcgctgcctgccccgcattacaggcgtctatggccaactttaagcacggataacgttgataatccggggttgtaaaggtcagcgcgcctactttgcaaaaatccaatggcgcaacacctgagctaactcgcattgggtaagccatcgcatgtgcaatcggtgtccgcatgtctggagtccccatttgtgccaggatacttccgtcatgatagcgaaccatcgagtgaataacagactgcggatgtaacacaacctctatctgttctgcgctggcattaaataaccatcgagcctcaacatactccaggcctttattcatcatcgtcgctgagtcgacagaaattttccgccccatagaccaatttggatgagcacaagcttgatctggggtgacatcagaaaactgcgaaagtggagtttcacgaaatgggccaccagagccagtcaaaataatccgtgaaacgccattttcatttaatgaagaatagcctaattggcgctgaattctttcaggcaaactctgaaaaatcgcgttatgctcgctatcaattggcagtaattgagcacggctgcgtttaacctcatccataaagagtttaccgcaggtaatcagcgactctttattggcaagcaagacttgtttacctgcacgaatagcggccaatgttgagggtaaaccagcaatgccaacaatcgcggccatcacttgatcgacatcatctaaagctgccaattcgcaggcagccgtttcaccggaatagacctcggtgtctgaaccctgttctgccaacaataaacgcagtgatttagctgagtgttcatcagacatagctgcatagcggggggagaactcaaggcattgctgcgccatttccctgacattacgcccggcaactaacgccgtgactttaaataattcagggtttgcacgcacaacactcaacgtgctgttgccgatggagccagtagagccaagaatagtcagttgcttcatgagggcgctctgaataactgtttggtgataggcgagatatcaatttgcctgcatggcaaacgataccatcgttccaggttttatggcgagtgactgccgaaaaaacatcgcgaagataagacattgatcagataaaacattgatcagacaaaacatgaccggaaaaaaagcaaagcgccgcctaaggcgacgcttatacaatgcgagtagagattaaaaatccatcaactcagcttcttttaccgccaatgcagcatcaactttcttgatataggcatccgtcagcttttgcacatcgtcttgtgaacggcgatcttcgtcttcgctgatttctttgtctttcagcaatgccttcactttatcgttagcatcacggcgcacgttacgaatagacacacgcccctgctctgcttctgcccgcacgactttaatcaagtctttacgacgctcttccgtcaatgctggcaatggaacacggataacagtaccggcggacgatggattcagccccaagtctgaagtcatgatagccttctctaccgcagcactcaggctacggtcgaagactgttagcgctaaagtacgggagtcttctactacaatgttagccaattggcgcaatggtgtcgccgtaccgtagtactcaacctgaatgccatcaaggatacttggagaggcacgacccgtacggattttactaatgtggttctggaatgcttccagacatttttccatgcgcacttcggcatcttttctaatttcgttaatcacgttgcgaacccttggaaactggttacttggctggccatagcttttgagtatagccggtgaatatacaaaccaacagttgctggctaaaggggcagacagaacaatgtgcttacccctgataataaggtctgtcgcttatttagcgatcaatgtcccttcattctcacccatcaccacacgacgcaaagcgccgggtttattcatgttgaagacccgaattggcaggttatggtcacgggccaaagtgaaggccgccagatccataactttcaactcttgttctaaaacatcctgataggttaactgttcgtacaatgttgcgtcaggatttttcaccggatctgcggagtaaaccccatcaacctttgttgcttttaacacaacatcggcttcaatttctataccgcgtagacacgcagcagaatccgtcgtaaagaatgggttaccggtacccgcagcaaaaataaccacacggttatgacgcagcaagctaatcgcttcggcccaactgtaattatcacagacgccattaagtggaatagcagacattaggcgggcgttcacataggcacggtgcaaagcatctcgcattgccagaccattcataacagtcgccagcattcccatatggtcgcccacgacacggttcattccagcctgtgccaaaccggcaccgcggaataagttaccaccgccaatgaccacaccgacctgaatgcccaattcaaccagctctttaacttcctgagccatgcggtccaaaacgctagcgtcgataccgaaaccttctgcgccttgcagggcttcgccactcagcttaagcaggatacgctgatatacgggttttgcattggttgccatggtgttgtgtcctaagcagcagtaataatattggagacttgaccgtcagatactcagagcagcggtgtgcgctaaaaactgagcggactaagtttataccctaaataattcgagttataggaaggcagtcaacgcgcttgcaacttgaagtatcacgggtatcgagtgaataaaatggaaccgcctattggcggccccatttggagcattaagactgtttgctcattgctgcaacttcagcagcaaagtcagtttcaactttctcaatgccttcgcccacttcaaagcggatgaagttcacgacatcagcgttgttttctttcaacagatcgccaacagttttgcttgggtccataacgaagttctgaccagtcagagagacttcgccagtgaacttacgcatacggccttcaaccatcttctcagcaatctcacgtggcttgccggattcgatagcaatgtccaactggatttggtgctcgcgagcaacaacttcagcaggaacatcgtctggcttaacatattcaggcttgcttgcagcgatgtgcatagcaatgtgcttaaccagttcttcatcagcacccgtggccgcaaccataacaccgatacgtgcgccatgcaggtaagtacccagaatgtcgccttccagtacagcgacacggcgaatgttgatgttctcaccgattttagcgaccaggtttgcacgttgttcttcgaacttagctttcagaacatcgatatcagcgattttttcagccagagctgcgttgataacttcttcgccgaatgctttgaagccagcatctttagcaacgaagtcagtttcgcagttcagttccagaatcacaccgtacttaccatcagcggaaactttagccaggatgataccttcagcagcaatacggcctgctttcttggcagctttagcctgaccagacttacgcatgttgtcgatggccagctcaatgtcaccattagcttcaaccaacgcctttttacattccatcatgcctgcggctgtacgctcacgcagttcttttaccaaagcagcggtaatagcaaccatttaaatttcctcggttctcttgtgaagacaaaatctcacattagatatgcaaagggggcctataaggccccccctaaccaacatatttcaatacctggttaataagggctcacaacgagccggacttattattcagcttctacgaagctttcttccgcctgaacggccagatcttgagaacgaccttcacggacggcggtagcaacagcgcctaggtacagtttaactgcacggattgcgtcatcgttaccagggatgatgaagtcaacgccatctggatcggagttagtatcaacgatagagaataccgggatacccaggttattagcttctttgatagcgatgtgttcgtgatcagcatcaacaacaaacagtgcgtctggtaagccgcccatgtctttgataccacccaggctgttttccagcttgttcagttcacgggtacgcatcagcgcttcttttttggtcagcttatcaaaggtgccgtcttgagactggatttccaaatctttcaaacgtttgatggactgacgaacagttttccagttagtcagcatcccgcccaaccagcgatggttcacgaagaactggtcgcagttgttagcagcttcttttaccgcttcgcttgctgcgcgtttagtaccaacaaacaggatcttacctttacgggaagaaattttagtcaactcagccagagcttcgttgaacattggtacagttttttccaggttgatgatgtgaactttgttacgtgcgccgaagatgaaaggcttcattttcgggttccagtaacgggtttggtgaccaaagtgaacaccagcctggagcatgtcgcgcatggaaacagttgccatgattaaaacctctatagtatcagttggggttatgcctccacgtgtcccataacaccgaccccataagcgattgataacaatcaaaaactttagggcaccccggtgtatgtgtcgacacgtgtgtgttatttacacatatgagtgcgattggtattgcccggctaaactggctatttatcgtcagaatacgtcatcggaagattcatattcatcggaatatagtgcggttcgccggcgcgctttataccataaacagccacaacacaccaacttttgttgtattcggtgaggccctataaaggaaaatttggcagcaaattgcttggctgataccattagccacagatttttattaatcgacagttatcttttcattatctgcatctcattaataacggcggctggctatttacagcccctacggacacttttgcatggcaatctcaatcaaaacacctgaagatattcaaaaaatgcgcgttgctggccgcttggctgctgaagtgctggaaatcatcgaaccctatgtgaaaccaggggtaacaacgggtgaactggatcgtatctgtcacgatcatatcaccaaccaccaacaggctatttctgcctgcctggggtatcacggtttccctaaatcggtctgcatctcggtaaatgaagtgatctgccacggcatcccaagcgatgaaaaagtgctgaaagagggtgatatcgtcaatatcgacgtgaccgtgattaaagatggcttccatggcgatacctcaaaaatgtttattgttggtaaaccgaccattctgggtgaacgtctgtgccgagtgactcaagagagcctgtacctggcgattaaaatggttaaaccggggatccgcctgcggacgctgggtaaagctatccagaaatttgttgaagcagagaacttctccgtagtacgtgaatattgtggtcacgggatcggtgaaggtttccatgaagagccacaagttttacattacgatgcggatgacggcggcgtagtcttgcaaacaggcatggccttcacgatcgagcccatggtgaacgccggggattaccggattcggaccatgaaagacggctggacggtaaaaactaaagatcgcagcttgtcggcgcagtatgagcatactattgtggtaaccgataacggctgcgaaataatgacgttgcgtaaggatgacactatccccaacatcataacgcacgagtaataatgacaagccggcaccgccggcttttttatgggctgcgttcctcatcgggtaaacatatgtctgacaatcacaccgaacactccctatcgctgacgctcactcccactatttctgagcagcccgtacttcccagcacttatcttgatagcgacatcaattgcccgatactgaagcaacggcttgacgctttccaacgctggcaggcagaggcatttaatagtggcacctctgccgaggtattaattgcggcacgcagtgattatatcgatcatctgttacagcggttgtggacattctatggttttgacaatgtgccagaaacagctctggttgcggtcggtggctatgggcgcggcgaactgcatccattatcagatattgatgtgttagtactgagtaagcagcgtctaaatgatgaacatgcgcaacgggttggccaactcattaccttattgtgggatttgaagctggaagtcggtcatagtgtgcgcacactggaagagtgcttgctggaaggcctcgcagatttaaccatagccaccaatatgattgagtcacggctgatttgcggtgatgtcgccctttttttacagatgcaaaaacatattttcagtgacagtttctggccctcccctcaatttttccatgcaaaagttgttgaacagcaagagcgtcataaacgctatcacggcaccagctataatctggaacccgatatcaaaagtagccctggtggattacgggatatccacacattactctgggttgcccgtcgccattttggtgccacatcattaagtgaaatggttgattttgggtttctcactaacgccgagcgtaatgaactgaatgaaagccagagttttttatggcgtatccgttttgcgctgcacctggtattgactcgctacgataaccgcctgctgtttgatcgccaactgagcgttgctcaacttttacgctacgaaggtgaaggcaatgagcccgttgaacatatgatgaaagatttctatcgtatgacacggcgtgtcagtgaactgaacaatatgctgctgcaattgtttgatgaagccatactggcgttagaggcgaatgaaaaaccgcgtccacttgacgaagagtttcaactacggggagatttaattgatctccgtgatgagaacctatttgttcgtcagcctgaagcgatcatgcggatgttctatctgatggtgcgcaatcaggatattaaaggtatttactccactaccgtccggcgtttgcgccatgcccgtcgccatctgaaagcccctttatgtcacattcctgaagctcgtaagctgtttatggccattttgcgccaccccggtgccgtttcacgtgcgttactgcccatgcatcgtcacagtgttttatgggcctatatgccgcaatggggcagtattgttggccaaatgcaatttgatctatttcatgcttatacggtggatgaacacaccatccgtgttttgctaaaaattgaaagcttcgcggatgaagatacccggccacgtcatccactctgcgtcgaactctaccctcgcctgcctcagcctgaattactgctgctggccgccctgtttcatgatattgccaaagggcgtggcggtgatcattcaatactgggtgcccacgacgcggtggagtttgctgaacagcatgggcttaattcacgcgaatcccaattagtcgcttggttagttcgctgccatttattgatgtcagtgaccgcccaacgtagggatattcaggacccggccgttattcagcaattttctgccgaagtgcaaagtgaaacgcgcctgcgctatctggtcagcctgaccgtggcagatatttgcgccaccaatgaaaatctatggaatagctggaaacagagcctgttacgcgaactgtactttgcgaccgaaaaacagctacgccgcggaatgcaaaatagccctgatttacgtgagcgtgtacgccaccaccgcctgcaagcgttagctctactgcggatggataatattgatgaagaggcactgcatcgtatctggagccgttgccgagcggattacttcctacgccactcgccgaatcaacttgcctggcacgcccgccatttgctggagcacgactcaaccaaaccgctagtcttagtcagccgtcaggctacccgtggtgggactgaaatatttatctggagccctgaccgcccatcactctttgccgctgttgttggggagcttgatcgccgcaacttgagcgtccatgacgcacaaattttcaccaatcgtgatggtatggcgatggatacctttattgtattggagccagatggcagcccgttggcacaggataggcatccaataatcagccatgcattacagcaagcgataaaccggtcagattaccaacacccgccgcgggttaggcgattatcacctaaattacggcatttcagcgtgccaaccgaagctaactttttaccaacccataacgagcggcgtacttatctggaattaattgcgttagatcaaccagggttactggcacgtgttggcaaaatttttgctgatttagggttatcactgcacagtgcacgtatcaccaccatcggcgagcgagtagaggatttatttgttttagcagataaagatcgtcgagcactgagccttgaaacccgtcgtgaattagcacaacgattggcagatactctcaatccaaacgataaactgtgatacaaatatctttttagtaattaatatttattaaaattaattttttactattcgtttttatcacgactcattttattacaacctataccccagcgattagcgttacaggcagcagcgaataacactgtaatgtcaagtaagatagggtatatcgatatcaggaaagagaccaagatgcagcaactacaaaacgttattgaaaccgccttcgagcgccgtgctgacattacgccagcgaatgtagacaccgtaacgcgcgaagcgattacccatgtgatcgatttactggacaccggcgcgctgcgcgtcgcagaaaaaattgatggtcagtgggtgacgcatcagtggctgaaaaaagcggtactgctttctttccgcatcaatgacaatcaagtaatggaaggcgctgaaacccgttactatgacaaagtacccatgaaattcgcaggctatgatgaagcgcgtttccaacatgaaggtttccgcgttgttccaccagcaaccgtgcgtaaaggcgcatttattgcccgcaatacggtgttgatgccttcctatgtcaatattggtgcttttgttgatgagggcactatggtcgatacttgggccaccgtgggttcttgcgcgcaaatcggtaaaaacgtccatctatctggtggcgttggtattggcggcgtcttggagccactgcaagcgaacccaaccattatcgaagataactgcttcgtaggcgcacgctcagaagtggttgaaggcgttatcgtcgaagaaggttctgttatctccatgggcgtgtttatcggtcaaagcacccgtatttatgatcgtgaaactggcgaagtccattatggccgagtgccagcaggttcggttgtcgtctctggcaacttgccatcgaaagatggcagctatagcttgtactgcgcagttatcgtgaaaaaagttgacgcgaaaactcgcagtaaagtcggtattaatgagttattacgcaccatcgactaagattaagagtagcgggctaaccacccgctatttttttgccttacgccttgcataccaaagtcattggcgacattttccgccataatagaaaactgtggaatataaaatcaaaaaggtggcgttatgtatgacaatctaaaaagtttaggcatcacacaaccagaagatgttgatcgctatagcctgcgtcaagaggccaataatgacattctgaaaatttacttccgcaaagataaaggggagttttttgccaagagtgtaaaattcaaatatccacgccaacgcaagactgtagtgtctgataatgcaagccatggctataaagaaatcaatgaaatcaaccctaatctccgctatgtcattgatgagttggatcagctttgtaagcgtgatcagattgaagttgatttgaaaagaaaaattctggatgacctacgtcacctggaaagtgttgtcaccaataagattgcggaaattgaagctgatttagaaaagctcaccaatggccgctaaatcaggggtggcatgataacctcggtaaccgaatacgtattgtgacaacgaaacttgccacaatacgcaataaaatcaagatataaagattactgaagcaaacgcccccattgttccacccatggcgcagatatcgcctctggttctgagtgctcaatagcatcaatctctaaccgttcgccaatccgtgtcgcgccctgctcctgcaatagctcatcgaacgtacgcccagcaccgcagaaattgtcatagctactgtcgccgagcgcaatgacgccatagcgtaactcgggttggaaccccacctgatcacgaacagcaacaaatagtgatgtgatgctatctgggaaatcgccctgcccggtggttgaggtaatgaccaacacataatgttgacggtaatgctgccagtcctctaacgtgccttcgtcaaataactttacctcatgcccttgatctttcaagatgttctcagcttcttctgccactaacaacgcattaccatagacagtaccaacaaaaatcccaacttgagccataaaagatattcctttgtagccaaaaaattattcattatcctgactggcagtcagcggaaactcaaccctttcaagatgaggggcaatacccgaccagccaaattgtgacatcaacccttgccagggttcatcccaacgagcggtaagcgtcagcgcttcaccggtcacagggtgattgaggtgtaaatggctggcatgcagcatcaaccgtgaacaaccaaaatgctgagcgacacctctgttctgacgtaaatcaccatgtgtactgtcaccaataatggggtgacgaatatgagccatatgccgacgcaactggtgcttacgacccgtttccggtttcaatgccaccaagctatagcgagcagtttcatagcggccaatcgccaaaggaacttccacttgcgctaatgcttcataatggctgacagaaggctgtggagccttatcagacttagcaaacttatccgctattttatccagctcttcggccatcgcgtaatcaacggtgccaccttccaatacatatccgcgcaccaccgcatgatacgttttctgaatctggtgttgctcaaattgtaacgacaacatacgagccacatcactggacaatgccatgagcaatacgcctgatgtcgggcgatcaaggcgatgaacggtatacacatgctgaccaatctgatcacgtaccgtttgcataacaaataccgtttcattgcggtccaaccaactacgatgcactaaccaaccggcaggcttattcaccgcaacaatgtgttcatcttgatagataatttccagcattattcactttctttattcaacagatcatcaaggcaccgtaattgtgccaaaagcgccgagtaatctggccgcccatcaccgctcagagcctcttcaaaatacggcgtaatagcaaaacgggtggggaacgggccatttagctccagcaatgcatacatccgggggagaaacacccactgtagccactgctctgccgccatagtatcaatactaaaaggctcgttactctcaaaagcttctgcttccggtgggacggtttgccagaggtcagtctctcgcatggcaaactcaatatcctgtaagctttgacgcaccttattttctgtactcatgattatgctctcaacccaaaaattgccacttaccggcaccttcaacggtgggcaagcataccattgaagggagaatatgcccaaattaacgccatcagcaatggattcaggcgagacaaaatctatacaacaaaacaaaaaaacaaaaaaaggggtactgttttaccagtacccctcaattcgttttatagcaatccagctaaaattgatgctccctgctcaatccctgaaaacttttccgtatggttatactaaccagcaatccatcgcaatgttatacaccatcccggcgttaatccttaggctatcctaacccaccaatcatcctgaactggctctcaatctccatcctggaggtgtcccttgtttcatcctgaaacgtcccttcactcgtcctaagcagtccctgtgttcttcgtcctgaagacacatcttccagatgcgttccctctccgccagatcctatccagcgagtaaaggatcgcttaatcagccaagcgaggcaaggtagtgtaacaataatgatgcacatacttttacatatggaaaaatgaatatttataacgaaatgattttattggatataaatctaacacgagaattttacatagaaagaatagaagtgatgtctcacagctggtgtgagagatctcgcacaccagtaacacgctaataagtgaaaaccatggggttactcaggcaataccggccgtaatgcatctaagaagtgactgagcgttgaagccagcagtgtgcgtttatcactaccaaattgctccaaaacaacatttccgctgacattacataatgaagccatcgtcatttccgacgaggtagtcgctaaaaataacgttggcgagagctttagccttttctgtgtaactaagtggccaatcagattttcctgtaaacggatgaaatcatcctcactccacacttgcagcaatgtaaaacgatggtttcccaaatcggccatcatatcgccagcgtattgctgagtgtaaaaatcatgaatatcgggatgtagctgaatctccaacgcccgttcaatattggtcaacgtcgcttctggcagaaacgcctgaggttgccaaaatacctgatcctcccccgtctccacaatacaaggtgaaggaacgccatatagctctttacttgcgggtaaatgcccggtttgctgctgccataaatcaatatagcgttgagtaaaactgcgaagtgccgttgaaatattcaagtccattcttattctctgtatcgcggcggcttgccctgcacctgagtggtaactggccccagctcagaaatacagttaagtgcggcataaattgataaactagcgctattgtaccgatctctcatcaagggaacagcatgtcttcatatcaaaaccacaaggcgttggcggaactgacgctgggcaaaccaacggcttactgcgaccactatgatgccacgctgttgcaggctgtgccgcgcagcatgaaccgtgaaccgcttggcctatatccagacaatttaccattccatggtgctgatatttggacgctatatgaattatcttggttaaacagtaatggcctgccgcaagttgctgtgggcgaaataagtttaaacgcagatagcatcaatctgatcgagtcaaaaagctttaaactttatctcaacagttttaaccaaaccattttcgccgataaagaaagcgtgcgaatgaccttacaacgagatctggctgcctgtgctcaaggtaacgtcagtgtcgcactgtatgatctggatgaaataacgggccaacccatctccaatttcaatggcgaatgtctggataaacaagatattcgtatcgatagctatgaattcaatgctgattacctgcaaggtgctgcgggtaaagatcatgtggaggagagcctggtcagccatttgctaaaatctaactgcctgattacccatcagccagattggggatcagtgcaaattcactaccgcggcccacagattgaccacgaggcactgctgcgctatctggtctctttccgccaccacaatgagtttcatgaacaatgtgtagagcgcatttttaacgacattatgcgtttttgtcagcctgaaacattaaccgtttatgcccgttatacccgtagaggcgggctggatatcaatccatggcgttccaacacagattttgtaccgctaaccggccgcttggcacggcaataaatgcgcgcctgtgcgcaatattaccgctcactgcacgttagtattggtaaaaaaagaaagacaacgttaaggttaattacagtattttacggccttttctgctgtcctacagtgatacacggaatacccccctcaggggcaaaggagtcattttgattacacatgtcagcccgctcggctcaatggatctgttatcacagctcgaagtggatatgctcaaacgtaccgccagcagtgatttgtaccgtttattccgtaattgttcactggctgttctcaattcaggtagcctgaccgataacagcaaagagttgttatctcgcaatgaaacctttgatatcaacgtgcttcgccgtgagcgaggagttaaactcgagttggtcaacccaccagaacatgcgtttgttgacggcaaaattattcgctcattacaagcaaacctgttcgcggtattacgcgatatcttatttgtaaatggtcaaatcgtcagtgcgagcaacttccagcctttgaatatggagagctccagtcatttgactaacctagtcttttctattttacgtaatgcccgtgccctacatattgatgaagaacccaatatggttgtgtgctggggagggcattcaattaatgaaaccgagtatttgtacgcccgtaaagtgggcagccaactgggtttgcgtgaattaaatatctgtaccggctgtggtccgggtgccatggaagccccgatgaaaggtgccgctgtcggacatgctcagcaacattataaaaaaggccgttttatcggcatgacagaaccgtccattatcgctgcagaaccaccaaaccctctggttaatgaactggttatcatgcccgatattgagaagcggctggaagccttcgtccgtatcgctcatggcatcattattttcccaggtggggtgggcacagcagaagaattactctatctattagggattttgatgaatccggaaaatagtgagcaagtgctgccgctgattttaaccgggccaaaagagagtgcggattacttcaaagtggtggatgagttcatcatgaatacgctgggtgatggcgctcgtaaatactatcagataattattgatgacccagacgaagtcgcccgtcagatgaagaaagcgatgccactggtgaaagagtatcgccgtaataccggcgatgcttatagcttcaactggtctattcgtattgaaccagatttacagcatccgttcgaaccaaaccatgaaaatatggctaatctggatctgtctcataatcaaccaccggagaaactggccgccgcattacgccgggcgttttctgggattgtggcaggtaatgtcaaggaagtgggtatccaggctattgaagcgcatgggccatttaaactgcatggcgatccgcaattaatgaagcaaatggaccgcctactgcaagattttattgctcaacatcggatgaagttaccaggtagcgtctatacaccttgctatgaaatttgtagctgatgaatagataactgtagttgatgaatagatcaattgaacccaaagtaattggcgttgtagttgagcagcaaaaaatgacaaatctgccaagagtaaatttaaatgctgcttgcagcggcctcgtcgagacgaggcctgtaaatagctcaagtcacgacagctgctgcaacgccaagtaagaagggaattcactgggcgactaacgttgcccaatattactcgggcttaatgacgattcagcccttacataaaacaggttatgcaaatacaccttcttattgtcgatgctcttaatttgattcgccgtattcatgcggtgcaggggtcaccttgtgttaaggcctgccagcatgcactgcaacaactgattcaacacagccaacccagccatgccgttgccgtttttgatgaagatgaccgctctgatagctggcgacatcaatgtctgccagattacaaagctggccgctctcccatgcctgataacctgcaacaggaaatgccactcattcgccaggcatttaatgaattaggggtagcatgctggcattcacccggtaatgaagccgatgacttagccgccactctggtggtaaaagttgctggagcgggccatcaggtaaccatcgtttctaccgacaaaggctattgccagttattggctcccaatgtccaaattcgtgactatttccaaaagcggtggctggatatgccgtttgtgaagcaggagtttggtgtattgcctcgtcaattacctgattactgggggctggcggggatcagcagcagtaaaattccaggtgttgcaggcgttggtgccaaaaccgctacgctgctactgcaacaagccgatacgttggaagtgctctatcagaatctggaatcaataccggaaaaatggcgtaaaaaattgcaacaacaccaacagatggcgtttacctgcaaacaaatcgccacgctgaaaacggacttattattgagtggcaatctacaacagttacgtttgaaaaaataatatacgcataaaaactaaggggccaataggccccttaaatatgatgttacgctatcgctaaaacctaataacgctcatcacggcggcccggtgcacccgaccagatacgacggacatgtaccgtaacttcttcgcggtcatggtagagctgtttggcatggatatcagcattaataccgttttctttcaactgctcatccatcattgccaaattttgtacaacttcttcatagcgctttttcattggtaatttcaggttgaagatcgcttcacggcaccaaccattgactagccatttggtgataagctgcgtgacctttgttggtttttccaccatgtcacacactaaccaataaatattgctgcgggtaggctcatacttaaaaccatcagcacggtgatgtgtgacctgccccgtatccatcaggctttgtgccatcaaaccattatcaaccgcttgtatcatcatgctgcgttgaactaattgataagtccagccaccgggacaagcgcctaaatcgacagcatgcataccactggctaaacgctcctcccattcatccgcggggataaatacatggaatgcctcttccagttttaaggttgagcgacttggtgcatcggaggggaatttaagtcgagggatccccatatagaatggagagttattattgctgtaagaataaccaacataacaacaacccggcgcaataaagaacacatgcaccactggccgatgtgcattctcacgagcggacagaattttctgttcacgcaaagcactacgcaaaggtaccgtcagcttacggcaaaatttgagtaactctttgctttcattggtgtcggccacctcaacacgtaactcgccagctttttcaataacgccaaccaacattcccacgatcggtgacacacggtcttctgggggtaagtctttcaataactcccccaccaccatcatttggcgggcgaaaataaactcgcggaacggtatttcacggatgagtcgatccgcatcctctaactggtagcattcaaacaatacatagccactgttttcttttacccgtgcaaaaccaaagatttcgagctgtgcagccttctctgttatttctgccgcacactctttctcaaagccggagcggcaatataaagcaattttattattcatggcgttctgccctttttcttagacgcagtgcgccaatcaacatcaaaatccatcccgccagaaaacagactccgcctactggcgtgatatatatccacagtctcaggtgtgatagagccagacagtataaactgccgctaaagagtagcgttccgagcgctaacaaggccccactccagtaaaaccaaagactgacctgccgttgcatcgcaacagctaatatcagaataaccaacgtatggaacccctgatactccagcccggtacgaatccaggccatttcattcagccccagagaggtgcttaatacatgagccccgaaggcaccgaaagcaacatagaaaaaaccgctcagagcggaaaatatcagcattaaacgactgttcatcgttactaaccttaaattagacaaagttatcgttatatcgcccggtaatcgccctattcgtggcaggttaccatcatgaatgggttgtcattactgcgcagatactgtaaccaatcaagtgcagtgattaaccaagcattacaattaaccaaacattatgattgatcagttttcataacgaaaacgtaatttctcctgctcgctggcagctcttgccagtatccactgacggaaggcggctattttacccagttctgcctgactgtcatgacaaaccaaataaaaagcattcttactcaccaatacatcgttaaacgggcaaaccaatcggcccgcttcaatctcagactgggccatgacattattcaccagagcaatcccttgaccatgaaccgcagcctgaaccaccatggcactgtggctaaatatcgggccttgctgcacattaatctgcggtacccccagttggcgggtatacgctaaccagtcacggcgtgaagtatcatgcaacaaggtgtgattagccagatctgatggtacttttaatccattctcaccagttagtaagctaggtgcacagacgggtaataggaattcagcatacaagcgctctgtacgcaacccactccaattaccgcggccgtagaatatcgcgacatccacatcatcagcgagcttatcctcttcccgatccaccgcttggatcctcacatcaatgcctggataagccgcattaaacccagacaaacgaggaactagccattgaatggcaaaactgggcggcaaactgacggttaacgctcccttcgcactgcgcgcttgcaacttacgagtcgcttcattaatagacgtgaaaatctctttgatatcgaggtaatagctctgcccttcttcggtcaacaacaaagagcgattacgtcggcggaacaatttcagcccgagaaaatcctccagcgatttgatctggtggctaacagcggcttgagtgacaaataactcctcggctgctttagtgaaactgaggtgacgggcggcggcatcaaaagcccgtaaggcattcaggggtggtaatcgttttgacatgaattggacacttttttataacggcccatcatcagatgaaaccctttgtttacttattagtttttataatccgagccattataaattgtccattgaggatacgccagtaaatacctatagtggccgcacttcccctagccggaacgaaaagtaggtttggtatcccaggtactgaaatgcttttggctttgtggtggtgatgttgtgtttgcaaatggtctggtatgccagacatagtagctaagctactgctttttttcacttcctgtacatttaccctgtctgtccatagtgattttatgcagcaccgttattttggcggtgcttttttttatcctattttcgagatgaaattcaacttgttgttgctaccaccttaatgttgtatccggtctcttctctccctcggtttagcattaaactcgttatctttaaccatttcttttacgtctgatcgatttacctattctcggcccccattcacacaggggtgactgatcatctctatctcatcgtctactttcggtttaccatcagtaacgatagtgcgaccatcactaatgtgtataacgtcccatcactaatgtgtataacgtcccatcactaatgtgtataacgtcaatgtgtataacgtcaatatgcataacatcattgctcaaacacgcgaccatgataaaagcaaaaaaatttcggggtcactcacaggatgccaacaacagtatgaaagtttttaatccaatggattttcgtcgggaattccctgcgctcagtgataaattaacctatctggacagtgcggcgaccgccttgaaaccacgtgcaatgattgacgcgacacagcaattttatcagcaggattcagcaacggtacaccgcagccaacatcaatcggcgctgtcattaacggttcgctttgaaaacacccgccaacaagtggctgattttattaactcatctacagcagaaaatattatctggacgcgaggaacaactgaagccatcaatctgatcgcgcaaagttatgcccgcccccgtttacaacctgaagatgaaattattgtcagcgaagctgaacatcatgcgaatttaattccctggttgatggtagcggagcagaccggtgcaaaaatagtcaaattacctattggccttgatcatctgccagatttacagcaactccctcaactacttaatgaaaaaacacgcatattagcgctggggcagatgtctaacgtaacaggcggtagccctgatctggctcaggctattaggctggctcaccaatatgactgtgttgtcgtggttgacggtgctcagggaattgttcattacccagccgatgttcaggcattggatattgatttttatgcattctcttcccataaattgtatggcccaaccggcattggcgtgctgtatgggaagactgaattattagaagagatgcccgcctggcaaggcggcggtaaaatgcttacccatgcatcattcgggggctttacacctcatgaagtgccttatcgctttgaagcgggtacacccaatattgctggcgttattggtttatcagcggtactcaaatggctggaacatattgatctggaagaggccgaagtttatagccaaggtttagctacaatggcagaaaataagctcgcacaattaccgggttttcacagttaccgttgtcagcaatccagtttattagcatttactttcgatggtgttcatcacagtgatttagtggcgttattggccgagcaaggtatcgcactacgtgctgggcagcactgcgcacagccactgatggcggctctgggagtcaatggcagtctgcgggcttcttttgcgccttataataccccccaagatgttgaaatgctttgctctgcgcttggtaaggcattggaactgcttcgagactaactgctgccaatgataattttcgatataccctaaatgattccagttgcaagagagcagcaatcaagtgaacgaaagccatcaacacaagccagcttgaagaatggcgggtatcaatatacaaacaagatgagaatatgatgattgccccacacccatttggtcatgatattacggctactgacctgatcgagaaattcagtgctcacaaacagtgggaggatcgctaccgtcagttaattctgctggccaagcaactcccaccgttgcaggaggcatggaaaaaaaatgaactggaattgacgggttgtgaaaacagagtctggctcgggcaccaacatttgccagatggcactttgcatttctatggcgacagtgaaggccgcatagtacgcgggctgctagcggtgattctaaccgccgtggagggtaaaacaccacaacaggtgctggccgcagaccccttggccctgtttgagcaactggggctgcgccaacaactcagcacctcgcgtgctaatggattacaagcactggctcaaggtgtacaaaccatcgcggccaaatacgcagaacgataattattcagaacaataagttgcagagtaacaatcgattatgacgcagtggcggctgactcgtgctgacgggccgctttagccatcatcttcttcaatacatgagacacagcaacaaagccaaacgtggcagtaaccatcgttgccgagccgaatccagaggtgcaatccatttttttaggtccttcggcagtgctgcgggatgcacacacagagccatcggcttgtggatagaccaaaggctcactggagaaaacacagtcaatacctagcttacctttgctgtttttcaccacgttaaaatcacttttcagtctttcgcgcagttttgcagctaaaggatcttggatggttttagccagatcaaccacggcaatacgggttggatcaatttgcccacccgctccaccggtagtcaccactgggattttatagcgacggcagtaagacaacagcgcagcttttgggcgcacactatcaattgcatcaataacatagctgaaattcttatttaaaagctcagcgacattatccgcagtaataaaatcatcaatacaagtcacatgacattcaggattgatggccagaatacgctcggccatgacttctgttttagcctgcccgatgttgtggcgcagagcatggatttgacggttagtattcgtgacacaaacatcatccatatcaattagtgtaatcgcaccgataccagtacgcgccaatgcttccgccgcccatgagcctacgccgccaataccgatgacacaaacatgcgcctgtgaaaaaagcgccaatgcctgttggccatagaggcgtgcaataccaccaaaccgctgttggtaagcttcggaataggctgtgctcatagacttgttaccttaataacgtagaaataataaatggcttcaaaaaagacgcttcgtactcaataagattctaagtactcatgcaaaagcggccaactggccgcttaatcaaaacaaatgtttaccctgtacatccgctgacttatcgatcctgattattcaccagtaatgacgaatcattactggtaggctcgctctgcgtgccacctttataagcagtgaacaacggaccactgctttgtgcatttttcagtacccagacccggccataatggttgtagaacccagcagcctgacctgcctcatggccaatcccttgataaatatcaaaatgttggccttttattgcgcccccaacatccaatgccaccatcaagcgcatttgatatttgccggtaaatttcccttggtcatcaagtaaaggcacttctgccaacagggtggtacccggcggaatcagagatttgtctgatgccacagaggctttagcaatcaatgggaccgcactggcccctttaactggcgcatacattaccggtttaaagaaaacgaaagagggattctgctccaacaactccctgacttcagcttcactgtggttttcagcccattgacggatagcctgcatcgacatatcagcccttgcgacttcaccgcgatcaataagtactttaccgatgctgcggtaagcgtgaccatttttacccgcgtacccgaagaatgtcagaggccgcccatcaccataatcaacatagccgctgccctgaacttccatcatgaaattgtctaccagcgaattggtatacgcgatgattaaattacggttatccagcgcacccgcataaattgccgcccgatccggtaaacggcgttttcctttagcaggcatacgatacagtggatgacgaaattcgccttgtggcgtgtagcgggcctgaagcacaggagtgtagtaaccagtaaattgtacgttaccgaagttatcgacaccttccatctgataagcattcaaaccaaacaagctcaacttactggtatcagcaccggccagcatccagttttgtaccgcattgaatgtatcgctgttgcggttatacagacccggtgaagactgattaatcactttcacctgatcagaataatctttggcgttgactggcttacctgccgcattgggttcgttcaccagttccagtgattgctccaggcgaccatccttatattgttgcccacgatcggttggccgtgattggcaaccggccagaacagcaatcattattccactcagtaggtatttgccccaacgacttgtcatttcacgccttctctttgactcattttatctaccggcgaacgataacaaacgcctatagataaaggaatcagcaggcagaaaaaaatctcgatgactgttatggagaaaaagaaaacagatagtcgataaattaatcgaaaaaacatatttacaggaattttatggtaaaactacttgcaacagatctcatccagagtatagtgcgctcaatcggacgcggggtggagcagcctggtagctcgtcgggctcataacccgaaggtcgtcggttcaaatccggcccccgcaaccaaccgatactgattaccagcagtatcaaatatagttcgatggtgttgaaatttaagatgtattcagtaaaatagcgatgcatctcagttgagaagtgatactgagttagtcgtgtagtgataatgagttaatagtgtagtgataataagttaatagtgtagtgacggacgcggggtggagcagcctggtagctcgtcgggctcataacccgaaggtcgtcggttcaaatccggcccccgcaaccaattacattataatgtcgtgaaagaaacagcagtaagatagaaaataagcattaagacggacgcggggtggagcagcctggtagctcgtcgggctcataacccgaaggtcgtcggttcaaatccggcccccgcaaccaattcttaatcatattgatatcatcattagacaccctatcgggtgtttttttgtttctggcgttctataccgtccttggtactcccctaagcgcaagtgcttatctgcgcctgccgcataattgctttgccctggtaggatgcctcgtcctcgtgtattgaactataaccacgctatttatagtcactctatttttgacagaaacacccattattttacagaaacatccatcacaatcgcgccattgccccgccattagcaaagtacgctttgataccagcaaaaatagattccgctatctgttgctgaaaacggctggtacgtaatttccgctcttcttccaaattactgatgaacgcagtttctaccagaattgacgggatatcaggtgcttttagtaccgcaaatcctgcttgatcgacacgatttttgtgcaatttgttgattttactcatccgactcagtacttctttaccaaacttcaagctatcgttgatagttgcggtttgcaataaatcaataatggtatggtcaagataaggatcaccacttttgctgaccccaccaatctgatcggcctcattttgtgtctgagccagaaaacgagcggcagtactggtggctcctttggtcgataaagcaaagaccgaggagccgctagccgcccgattggtaaaagcatcggcatgaatcgaaatgaataaatccgcacgaagcttacgtgcttttgccacccgaactttcagcgggataaagacatcttcattacgagtcataaacacccgcatattggcttctttctgaataagcgcccgtaaccgacgagcaatttgcagcacaatgtctttttccttggttttatttttgccgatagccccaggatcttccccgccatgtccagggtccaacatgataataatgggtctgtcacgccctgctttacctgctttgggtgtttctggtggcaaggttcgatccacattacctttattgtaatcttccaatagggccagcagcggatcatcttctgccgatgtgcccccctccgcagggtacagatcgaccactaagcgattacggaattcagcgaaaggtttcagggtaaataattgagggctgatactctgcttcagttccaataccaaacgaacagtatttttatcgaactgccctacccgcgcctgtttgagataagggtcagcggattgaacttgccggctgatctctttcaatacgctatttagctgtacgccttcaatatcaacaacaatacggtcgggatgagttaaggcgaattggcggtacttcagtggtgtatttgactctaatgtgactcgggtgtaagtagaagagggccacacccggacagcaacaatatgtgaagatgcggcaaatccaacccggcttatactcagcatccaagctgctgcggcaccttgtaatagacggcgacgaccagaattatgatttgaatctgccatgtaactccaaagtaacaactaaaatctaatgaaaaaacaaaccaaaaaaattatgaggaaaaactttaacgaatcaatttaacgctgtcatcagaaaaacatctttatgtgactcagtttattaatacatacactttatatatatgcagttagtatcaatttcgtgcttgccatcttggtcaaaaaagaataaaaatacaaaaataccgaataaaaattcaaaagaggatctgccgtgaaggaacgtagtactgaactggttcaaggatttcgccactcagttccctatatcaatgcgcaccgcggcaagacatttgttgtcatgctaggtggcgaagcgattgaacatgaaaacttctctagtatcgtcaacgatataggcttattacatagccttgggatcagattagtcgtggtatacggtgcccgaccacagattgacagtaatctggcagatcataactacgaacctatttatcataaacatacccgagtgactgacgcccggactctggagatggtcaagcaagcggccggtttattacaactggatatcacggccaggctttcaatgagtttgaacaacaccccactgcaaggtgctcatatcaacgtagttagcggtaactttatcattgctcaaccgctaggtgtggatgatggtgttgattattgccatagcgggcgtatccggcgcattgatgaagaagctattcatcgccaattggataatggcgctatcgttttgctggggccagttgcggtatcggtcacaggtgaaagctttaacctcacatcagaggaagttgcaactcagttagccatcaaactgaaagcggagaaaatgattggattctgctcatcacaaggggtgactgatagcgaaggtaatattatttcagaattgttcccaaacgatgcgcaaaagcggattgaagacctggaacaggatggggattacaattcgggcacagtacgtttcttgcgtggtgccgttaaagcctgccgcagcggtgtgcgccgtagccatttactcagctatcaggaagatggcgctctgattcaagaactcttctcccgtgacggtatcggtacccagattgtcatggaaagtgcggagcaagtccgccgagccaccatcaacgatatcggcggtatcttggaactgattcgcccattggaacaacaagggatcttggtgcgccgttcacgtgaacaattagagatggagatagataagtttactattattgaacgggataatttaactatcgcttgcgccgccctctatccgttccctgatgaacatattggtgaaatggcttgtgtcgcggtccatccagattatcgcagctcctcccggggagaaatgctgctgaataggataaccaatcaggcgcgacaaatgggccttaaaaagctgtttgtgctgaccacacgcagcattcactggttccaggaacgcggttttacacctgcagaggtagatgttttacctattcaaaaacaggaactgtataactatcagcgccgttcgaagatcttactggccgatctatagccccctatcccctttatacatgcgtaaatgaaattgggggtcagggcggcggctacgctcacgcactcgaatcacttattggaagtacttatttgaaatacttatttgaaacagataactcagggcgcttatgccctgagattattggcgatttaatgtattcaagcgatcaactagcccactcagccggagagtcggtgtacgtatggcatgacttagcacggcatcgctgcaataaagcgtcagatgctgacgggcgcgggtaatggcggtatagaccaattcacgagttaacacgggcatgaacgtgttaggtaataccaatgctgtgtgttcaaactctgaaccctgcgatttatgaaccgtcatagcataagcggtttcatggctgggaaggcgactaggttgtactgactttatattgccatcgggcaattgaaaatatacccgtagctcgccttcattatcatgtaaggcaataccaatatccccgttgaataagccaagtgcgctatcattaagttctatcatcactggccgcccaacataccaacggccagaaggccctgatggacggataatgaatcctttacgatgtaaaacctgttcaatgcgttcgtttaagccactgacaccgaatggcccggaacgtaatgcacacagcagttggtagcggccaaatgctgccaatacctctgccgcaggggctaacgcagccacccgttcgaggtaatgctgataccccacagcacaagcctctagcagtacctgataatcttcctcatcggccagcgggaagcgttcaacatcagaatacgcactgtttaatacggataaagcctgccgatactcccctgcattaacggccagagcaagctgcccaatccctgacttttcatcgaagcggtaacttttacgcagtaaacacaggctatcgcgtacattcgctgaatcagaataggtttcatctggctgcgctttattggctaatgccttattggttagtacattgctggttaatgcattattagttaataaatagcccgttaactgagttaattgctgtgcccgttgctcgctgtaacctaattcggcaaaacggcagatatcccccagaaccgcccccgcctcaaccgaggccagttggtcacggtcaccaaggaatatcaccttggccttggcaggtaatgccgcaattaagcgcgccatcataggtaaatcaaccattgatgcttcatcaacgaccagtacatcaagatttaatggattaccacggtggtaacgcaggcgctggctattgggctgaacacccagtaaacggtgcaaggtcgaagcctgatcagggaataatttacgttcatcatcagtaagagagaattgccgaatcgctttgcccagtgattcagtaaggcgtgcagcggctttaccggttggggccgcaagtttaatacgtaaacgttgcccctggctaagccgtatcaatgctgtcaaaagtttggctactgtggtggttttccccgtgcccggcccgccggaaataactgaaattctacgggtagccgcaaccgctgccgccactttttgccaatcaacctcactaccagcacaaccaaacaaagcgtctagcgtctcccgtaatagcgattcatcaacagaagtggcaatacctttactggtcataaaatcactatctctgtttataaaaacagagtcactggcaataaattggacgacatctccttcgtactgccacattcgttgcagatataaacgttcctgctgtagcactaatggtgttggttgagagccatcactgactactggggcgttttgtaatgcctgtagccactgtgctttatctggcgagcccgccgcctgccatagcgccagtgataaatcgggttgccgcccaccgaatagcagttctggctgtaaatagcgtaatggcaggcaaacatgaccggcccctacttctgcactaaggatcgctgcggccagttgtaaccgcgggtcatcatcgccggcaatcattcgtgaaaactgcacatccagtgggcgcaataagcggtctcgagcagcctgagccaatagcgtcatcatcgtgatgccctctcgccgctgtgaatgacattgctaccgcttttgtcactcgcggttgcgttactgccaattgtgccactgaataagcgatccatttcttcaatcagtttctgttcaggccggcaattaaaaataccgtgccctgaatgttgctgatcaacgccgcgcaagaagaggtaaataaccccaccaaagtggcgttgatagtcataatcggccaaacgatggcgtaaatagcggtgtaaagccaaagtataaagttggtattgcagatcatagcgatgttcagccatcgcttgtgtcatcgcctcaacggtataagcacgactgtcctcacccaaccaattggatttgtaatccagcaagtaatattgcccctgccagcaaaaaaccaagtcaataaaccccttgagcatccctctaacctgttgaaaatccaatacagggcactgccgggaaagtggatcatactgtttgattaaacggtctaatacctcggcccgtagcaggctatcgatgggtagataaaattgtagctcggcctgtttgcgctctggcgacaacccagccaaagtggccccggtatcggtaagcggcgtttgcactatatcatttagccactggtgtaacaccggtgcccactgttcgctaaaaccctgttgctgtagccgctcagacaaccacgccaattcaatcggttgactaaaatctaatggctcaagcaaatcatgtaagaaagtccctggggccgctccccgagggaaggtatgaggtgttaaatggtcgtcttctgtcaccaccgcctgctcacctacggcatcaatgtccaaccgtggcaacaagacctgtaatggtgcccccagagcctgcgatacgtcccctgttgcagaaccatacagcttctttgtagagccagactgctgtaaacctgaatagctggttacgcgccaataatcttgcatttttcgggtaaaatggcgggcggtaagttcaggcaaggcttcgggctgtggttgccaaggtttatcatcaggaggctcaacgggcgaaacgcaaatatcaccattcgatgagcgcgctaactcagttaacttttcgcttagaacatgagcatcaccgggttgaccatgctgaaccaaataacctaacgcactgcgatgcatatcactctcgccttgctttttcctcccccctttaatcagcggtgcaatgcccacgctgcaatgataaaccgaacgcgtcaacgcgacatacaatagccgtaaatcctcagccagacgttcttcttcagctaaagcctggctttcttcatcagcattaagatcgagtaaagcctcaaagctatgtcggtcatggtaaagcacattctgttgttgccgaaaattaccgataaaaggcagccaaactaatggatattccaaccctttcgatttatggatagtaaccactcgaaccaaatggcgatcactttccaagcgtaattgttggctatctgactggggattgggttgagcaatttgctgggccaaccagcgaattagtgcgtgctcactatccagttgcgaggcggcctcttgcagtaattccccaagatgtagtaaatctgtcagccgacgctccccaccgggtgttgccaacaagttttcagctaaatggcggcgggccatcatctcccgcagcatgggtaataccccacggcgctgccaatgctggcgatagtgatcaaactcatcgaccagcgcatcccaagctcgctcatcgtgatttaacgcatccaacattctggcatccaaccccaagatccccgtagccatagcactacgtagtgcgcgctcctgctctggtgctaacacggcttgcagtaaccacaagagatctttggcttctgtagtctcaaagacactgtcacgattagataaatagaccgatgggatcgccagcgcactaagtgcatcacgtatcaatgcggcctctgcccggctacgcaccagtatggttatatctgatgcctgaaccggttttggtcctttcgtggtcagtagttctgcttgcccctgctggccggcagtcaaccaatcacgaatttgcgctgcacattgtctagccattacttgttggtactcacttacaccaacaccgtcaccgggttgcagccaaaaatgtagcgcaggttgcttttctcctttaatttcaaaggataaatcatgattctttttggcggcggcgacattaataaaggggatttgctcaaataagaaaggcgtattaaccagactaaatagcctgttcactgattgcaccatgggaaaagaagagcgccagttggtttccaatgtgtagtgggcgcttacttctgaacgggcgcgaatataggtaaatatatctgcgccacgaaaagcataaatagcctgtttaggatcaccgatcaacagtaaagcgcacgcttcttgcccgccataaacggtgtggaaaatgcgatattgttgcgggtcggtatcctgaaattcatcaatcattgcaacggggtaacgggtacgaatagattgagcgagcaactccccccccgattgttgtaatgcggcatctaacttactgagtaaatcatcaaaccccagctctgcacgctgccgtttttcctgctgtacagaaaaccgtatttcgctgatggctcgggctaaaataagatccctcaacgttaggggctgttcaaatatcgagtctatcgcactaaataaagtatgttgtggggcggctcccttcttggtcttttccaataacaccgactggcgaaatttttccagttctttgggtaattgataatcttccgtttcctgctccgcccataatcctactttttccagccagttgggtaagtgcttgctgctataactgcgtttatcaacgccagaacgactaattaatgcttctaattcaggggcggctaagcgccactctgctttaagtgcatcaatctgtgtcacaacgtgctgatggcggctaaggatcgtttcatcgtcaccgggcgcttgccgaaactttggcgtttcaccttgtaaataagcactcagatcactgagtaatgcctccggcccgctccactcctgactgaccgcccgtgcgatgactaagggaagcggataacaatgacgccgccagaagtcagcacaggcctgccgccataacgggagttcatcctgaactaacgtttgttcgaataaaatgccggattcaaaagcgttatttgccagcattctttggcagaaaccatgaatagtgtaaatcgcggcttcatccatctgacgctcagccgccaataattgcgcggcggctacggcccaatcggtgatttcggctaatagagcctggtacattgggtcatcactgactccccgaacgcaagcgatacgcaacccatgaatattatcgcgaattcgccccctgagctcttcggtcgcggcttcagtaaaggtcaccactaggatttcctccaccatcaaagggcgacggaatgcagcatcgccccctaacccaagcaacaatctaagataaaggaccccgatggtaaatgtcttaccagtaccggcagaggcttctatcagcctctcgccatagaggggaagcgccagcggctcaagccgctggggagtcgtgggtgtcatggtgccaataccttctgcggcagcgtagcctgtaaagcggaagtggttggataagtcgtccatccctccggtactgcgaatcctccggcctgcccctgacctttaacttgagaaagcagtgccagaccttgtggtttaatgaccgcttgctggaagaaatccgccagttcattagccgtaagctgtttcacttgagcaatcatcttctcacggctatcaaatgcaaaattattgagattgaagtctttacggtagcgctctgcctcttcatctaatgtctgtggcctttgcaatagttgattgaccagcccctgcttatattgttcaaaatcatcgggcttcatttcgcgcaggcgtttttcagcttgcggatagaatgcgaggtatcgctggtaaagataattaggttccttactattactttgcagtaagaagccgatgccccattgatggccaaccgacattgggaaagaaaatacagcataaccaagctgttcttctgtccgtaattgatcatagaaccatggttgaatgatctgccctaacaaggcactacgtgccataccagcaatttctgtatagccagtagggacataaactgctgccaaagccgcgtcagaactactgccgacccgttccatattggccaactgtgttttctcaataatgacatcttcaccgacccaccacgtggttccgattaagttcagctgttttttcagcgattcagtgagttcagtgacttgttcggctgtcatattgcccacggccaaaacttctatcgcagactgtttcagtaaatcatctctataggtcagcacatcctgcacactaatgctatcaagtagtttacgtcgctcacttcgctccgaataaggcacattcgatagcagcttagcgggctgaatagccaactcataagctttgcctttctctgccacgtctaattgctcacgataccaagatttagcctgtaccaattgctcttctgtcggagtaaaactggcatagcctgaaaccaaagatgtcagtaactgcggcatacgctgtgtaaaaccaccagcattaacatacaagccattgttcggtgcggtagagaaactgatcccaccaatagaggcctgataactcagttgatcaagtgagagacccgcaaggtaatccgtcagggcaaaaagcacctgatggcgagctgagttcaatgcatgagggttgcggaaagcaaccgtaatgtcggctttgggttcatcagcaaaatactgacttggcatgtaaaacacccgcaatcctggctggtctgccacgttctgtgggcgggtaatgttcttgtctgctttgatcagagtgaaattatcaggaatgtacgggttcagtgctggcaaacttagcgcaatcttttgccccagttgctgccattctttcatccgctgtacgcctattttatcgacctgataaggtgcatcgacaaaataagctactttgttatgcggttcttcagggctgacaaaccagatgcgggcattttcaggcgtcatctcggccaatcgggatgcaattgctttgggatcatactgatcagccagataaggcgcatcaagcgtatgtgcaacaggaactcgtaacatcatatccacgagccattcgatataatccatatcacgggtgatagagggataacggaaatcgagattcaatacatgtgcaatttcatcgaaatagctttttttaatcccctctttatgcagcatattgatgtaatcaaaaattgccgcgacgacaacatcacgttgtgccagccccttatcggttagtgagacagtgatagagaacacccccccatttctatccaacattgggtcagcacccgcattgattgcatctgccagcccctgtttttgtagccagtcagataaggtgtttttactgcgattactgatcaagtagctaatataggtatctgttttactacgaaaatccgcactattgttcgcaatgcggaaatcgacttttatctgtttacgaggttgagcaggaacatagtgaatgatgattcccgtttgatcaggtgtcacgactgggaccgtaatcgtgggtacttttgcatccctattagggatacggccgaaggtgtctgcggctaattgtgctagctgctctaatgattggttgctgtacaacaccccgaccatgagattggcagaatagtagcggtgatagaagctcaccaattcatcatgtagcttgccatcgggcttgtccctaagagtttcaaggttaccaccagaaaaacgtgcgcttggatgtgccggattaagcgtttccgcattaacttgcgccatacgcataccatcgcgtgaacgggccatcgtcaattcagcattgacagcattacgctcacgatccgcattaatggggtctaacaagggttcagcaatggcatccgccaaccgctcaaccgcaggtgccaatgcatcattttcaatttcaagatagaaagcggttcggtaagaagccgtgctcgcattatggctccccccatgcttttttaggaattcggaaaaactgccaggttcagggaaatgtttggaccccatgagcaccatatgctccaagtagtgggccaagccgagctgattatctgggtcttccagtgaccctaccggtagcgctaaggccgccaaagatttaggggcttgtgtatcggaaaccagtagtaccgtcataccattggataattttattgcctgatatttacgtaagtcatgttcacttttgtaaatggtttccgccaaaggttgccacgcaggaattgcagcccaactcgatggagccagtaaacctaaaaagaaaacgataccgacaatgcgggcaagctgtttatgcattccatttctccactagcttcataagaatggtcactaaagcacgtattggctttattgtattgaactgacaacaagcgctcttcacgccttattatggcgagctatcggtaacaaataacgttcagtttcatgtaaaattatgtccaaatgttggttgtccattcgtctgcaaaccctttgtatatagtggtcttcaccttcgcctgtcactctctgatcaccttgccaaacctgtaaaagtttcatccgtgctttaccttgcgtctcttcgtcccacaaaatttggcctgactcacgatcaaagcattggctcaaccacgcccatccacttttactcaagagcatcaatggctcacataaaccttgttgataacctttaatgagttgttgtaaatagggccgggcttcatcagccgccataggggcataacgccaggcagtcccttttcgtccatatatccggctttctccctcaccacccgccgaacagtacacgagatgttcaagccacaataaaaggccatcgacggcggttaatattgatggccgccaacggaccaaaccatcgtcctgaacctgatgaatccatcccgtaaccgtgatgtcagcgaattcaatgttgagttcaatactgtgattctctttacgttcactgcggatttgttcagccaagggtaccatctcatcttgttgactctcccaataaagttcaccaaaagatccatatggcagtacgccggcagctctggctctggcaaagacgctattaatatcgtcctcatttatcagcgcattaagtagctgggtattaaattgataacggctaaggttatccaaagtaaatggctcttcgtcaggtaattctgtttcttcaataacaaaattaacccctagccgcagttggaaaaatgctctcactggatggcggtaaaaacgcactaattcatccagtgtaatttcagccagcggctcagcctgtagcggttggttaaaatttgggtgtgcatgccccttcgactcggcagaaggcagccattcagcggcatagctctgtaattcgctatttttaataaaattttcagcggagaatggcatacgggcatgccaacataataagtgctgcgtcacccgttgtgcactgtcatcagcactgagtttttcatcgcccggtaaatgatagctttgtgcgacatattcaattaactcgcttaccagcacggaaggataacgcttactgttgtcttgaatagaacgcccaatgtagctgatataaagctgttgctgagcagatagcagagcctctaggaacaaatagcgatcatcgtcgcggcggctacggtcaccccgacgaaccttcttggccattagatcaaatccctgggggggcaatgttctcgggtataccccatcattcatgcccaatagacaaaccactttaaatgggatggagcgcattggcattaaggtacagaaattgataggcccggcgagaaaacgttggctaatacgttcattatctaaacgtgccgccaattcgtctcgtagcagattaagtggcacaacgtctggatattgagctgcaataccgtagccgatcactttctgccactgttgttcaatcagcaccagagcggcctcagtgtcattgtcttgatcgaagaacgtatccaataattgacgacatattggtaaccattcactaagttctcggggctgacctaattgttgccgccattgactcaggtgcatcagcatatcggccaactgcccggcgagttccgctgccagcccgctggattcatcgtaaggcagaataccttgccaatcccctgcggtactgtccatcgcataacccagtagcatgcgggtcaaaccaaaacgccaggtgtgttgacccgtagcaggtaaggatagctcccgcacattatcatcatccaatccccaacggatgcctgactcaccaacccattgtcgcaggcgccgtaaaccatcttcagtgataccaaatttggtcgccaaagcagggacttccaacagtgccaagacttgttcagccgtaaagcgactctggggtaaatcaagtagggtaataaaggcgtgcaacgcaggatgagcctgactggctttgcgatcagaaatcgcaaacggcagataacgctcagacggagcattaccaaacgcagcttgaatatacggtgtataactgtcgatatccgccaccatcacaatgatgtcgcgcggggtcaattcagggtctgcggctaatagcccaagtaaatgatcttgcagcacctcaacttctcgttgtcggctgtggcaggcatggaaactaagtgaacgatcatccagatctaatcggcgtttttgatcactacgcgctaaggtttctggggttgtgccaataaccgcgtgatcttccaactccagcatatcgtgttgaatgccatgcaaaagattatctggctcgatatcgacaaaagcatgaacctcttgaatctcatcaatttgagagagcaaatacatgtgatcccgccctaatcgcccccatgaggccaagagtgggttactgaggttctgctcaccatcggtattaaatagttgctctgcctgctgcgggtggcgaaacagacttagttcaatcgattcacggtaatgccgacgtttacggctttgtaatttagcgaggaaagcgtaatcctgaatatctccccagaagtaacggcaggggttagtaaacatcaaatggatatcaatgtgtttacctaatgcttgtagggcctgtaaatagataggtggcaacgccgatataccacatataaatacccgtttcggtaacccttgcgggcaaacgtccgacttgagtagttggtggataaaacgctgatagaggtttgcccggtgccattccggttgttccaattggcgagtatagcgggtcagttcaacccacagtaatgcttgccattgctgtgcatcatcaagcccctcaatcaattgcccacgttcccaactttccagccattccggacgatacaccagatattggtcaaaaagatcggctacccgtgccgcgagttggtgaattttacgccgatccccatcatcacttaaatagcgcttcatgggagaaaatagtggattctccaataaatctggcagtagccacataagtttccaggtcatagcctctttgctgaatgcactttctttaggaatatcaggcagaacgcgggtaaacatatcccagataaaagtagcgggtagaggaaacactatattggcagcaatactgaactgttgagccagttgcatttgtaaccattgggccatgccggggctttgtactaacaccacttcttgctggaaaggattatccaacggttctctttctatcagcgcagtggtgagcgctttgagtaaatccagttgattagaatgataaaccgtgaacatggtgactcccttaagacacgatggaaaatacccaaaagtgatgcatcaacttattatcgctgatggatagttcctgacgttgaatactctaacttgataatgagtctgcgcaacaggtatcggtaatacataccctaaatcatctcagttgaacaaaaccatcggcttaattctactggcgagtcttggcgggttatcaacttaacgctaaattcccggcaatccccctcaatgcgatcgataaattggcgatagtgccagcctggtttcacttcaggtgcccaccgttcttcggggtctgtaccgctctgactctccatatattgatgtaaccacgaccaggcttgccgttgttgccatgaggaggcaaagccctgtaaaagtgcctgatggtattgcagtagccccagtagtgagattgagaaaaataatgcggcaatcaaaacttccagtaagctgaatccacgcaggtgacgtaggttgaaaccgcctgtctccactgaaatagtttgtccataagcgcgtttggttattaatcgaggcaaaactgtgcatccttatcagggcaaaaatccaaccaaccatgaggcgtgtcaatcaactgataattccccgaacttcctgtaactgccttcagtttaacacgttggtaaagcatcagcggagggagcgacccaagcggaagactttctcctttgagaataaaaaaacccgccagtgatgaccgcttaacgcaagcttttaagccgagctcctgatgtgccatgcaatgccatgctgaacctacccgccaaggtattctgagcgcccagcgctggctgacaccccagttgagtgatgattcagcctgattgtaagcccgtaaatagcgttgttcctctccggtaatttgctggatattgtctaattgccgatgtatcgctgatagccaaaataatcccaaagaaaaaagtgtcataaccgccgccagggtactgctgcctcgttgaaatacctgcgtcatacgttattcccacggataaggtaagtcacctgatggtggatagctggattacccgttttatgccccacaagccgcaatttgaaaagttgcccagacagaggggttacggaaaagtgagtcacagtaacatctcgtggatcaaacagtttttcccaaccacggccatggcagttcagttcgccacgctgactctctaacgctttattgcgtagccgatagccaaaatattctgactcttgatgtttcgccccttcccatctcccattgcaattaagatcataagcaacaatcaggcaagagtgagccgtttcaccgagataatgttctatcgttatggcctccccctgacatttcccgtggcaaaagcccgctctgcgcagatctttctccatagcccccatagcctgattcattactaattccaggcgataatgctgttgcaacaccgaaatttgctggcttaatttgggtaagacctgtgctgtgctcagcgctatcaggctaccgaaacttagcgccagcatcatttcaggcaaggtaaaacccgcggttcgtgttggctgcgcgttgagtggggtagacaagacattgaccactaaaggcataaatggatgcctgccatggattgttgttcactacataaccttatacgcccacggcttgagataaccagacgaatacgtcctgcggggctactgagtatgatgttacccgcttgggctgtatttcgaacaccgtaaaaacccatctctttttgtagcgggagcgttattgcaatatcgcggtaaggcgggataaataacgacccagccagcccagtacagggaggtgtcggtttatgaccactccccaaacacccttgcccatccggttgggcccacaatatggcagtacggttattgcgattagcttctgcctgtaagtgagttaagaaagcgagcaattggcgagcactgtcggcaagctttgcccgctgtcggtaatgatgccagctctgccctccccataaggtcatgacactgaccaatgtaatgactactaacagttcgattaggcttattcctctttgttttattagtgatctttgttttataaaaactttttgctttctaagcaaaggtgcctttggtaatagcttgccggtttttatgctatagattttcatgccgtgagtttacgttgctgaaatttgagttccagaggcaaatttccggtgttggaaggggtacgcaaaacataatcaatggatacagaaatacagggaggtctgcgatacgactcgcatttttatcggaagactggaaaaaatagacaagataggggtaaaaaagcgtaaaagagataaagaggtaaaaaggtaaaaaggtaaagagataaaagacgcaaaacggagccattacagctccgatatgaagattaaatcgcgataggggctttaataccagggtgaggatcgtagccctcaatatcaaaatcatcgaaatggtagtcaaacaatgaatcaggtttacgtttgatcaccagtttcggtaatgctcgtggctcacggctcaattgcagatgcgtctggtcaatatggttgctatacaagtgagtatccccgccagtccagacaaaatcgcctacggccagatcacactgctgcgccatcatgtgaactaataacgcatagctggcaatgttaaatggcaagccaaggaacacatcgcaagagcgttggtacagttggcaagaaagtttgccatcagccacgtagaactggaaaaaggcatggcatggtgccaacgccatttgatccagttcgcccacattccacgcagaaacaataatccggcgcgaatcagggtcctgcttcagttgattgactacgttactcaactggtcaatttttcggccatcagcagccccccaagcacgccattgtttaccataaatcggaccaagatcgccgttttcatctgcccattcatcccagattgagacattattttccttcagataagcaatgttggtatcgccattcaggaaccataacaactcatggataatcgaacgtaggtggcaacgcttggtggtgaccaatgggaaaccgtcttgtaaattgaaacgcatctgatgcccaaaaattgacagagtgccggtaccggtacggtcagctttaggtgtgccttcttccagcacttttttcatcaaatccagatactgtttcatgttacctcacgaaagtttttgcgtaggacggcgatatgcccaaatcatcataataataccggccagaatcataggcacagacaatatctgccccatgctgatcatgccctcgaacaagccgagttgttcgtctggttggcggaagcactccacaatgatgcggaaggtaccataaccaatcaagaacagcccagagacactgcccatgggacgtggcttgcggataaacacgttcaggatgataaatagcaccaccccttcgaggatcatttcgtacagttgcgaggggtgacgcggcaagacaccgtattgattaaatatcgcctgccatttagcaggatcagcggccacgatggcaatatcggtattacgggaagttgggaataacatcgcccacggggtatcggtagtgacacgcccccaaagttcggcattgataaaattccccagacgccctgcgcccaaaccaaaagggatcagcggggcaataaaatcagcaacctggaagaaattgcgtttggttcgacgggcaaaccatagcatgacacaaatgacaccaatcaaaccgccatggaatgacataccgccatcccatactttaaacagataaagtgggttatcgaggaacatcggcaagttatagaacagaacataacccacgcgaccaccgataaagacgccaaggaaaccagcgtacagcaggttttcgacttcttctttggtccaaccactaccaggcttattcgcacgacggacagcgagccacatcgcaaacacgaagcccaccaaatacattaggccgtaccaatggagggaaaccggaccaattgagaaaatgaccggatcaaatttaggaaacgccagatagctattgctcatctatcaccacaaaatgtctatcgttcttgcccagttagggctacaggtagcgcataatagcataggccaaggccactctggggagcaccagtaggaaaagttctgtaaacaacgattgctttcttaattaagattgcagcggtgttagccgctctcgcccctttaaatcactgatctaaggcagcgcattgagattcattcacttgctgcctgactgcaacctcaatgatttttggtatttataagcgttctacttcccaccccgaatcagcccacctaaaccacggcgctccataaatgcagcggttaggtggcgcacatcggtggtcatctgcgcggttaatacccgtgccgccagcgcttgtgcatcggccaattctatattacgtaacaggtatttgatgcgtgccacactgcggccgttcatactgagattacggtaacccagcccaaccagcagtaacgcccccatcggatcaccggccatttcaccacaaagactgacttgcaggccagactctgttgcctgcatcagaatttggcgaagcacttgtaacatcgctgggtggaggctgtcgtacaacgaagccacccgggtattgttgcgatcaacggccagtaaatattgcgtcagatcattggtgccaaccgagataaaatccacccgagacgtcaagtaaggcagcatgaaaatcatggatggaacttcaatcatcacccccaaccgaggttgtggcagcacataaccgagcatttcctctacttcgcgacccgcacggtcaatcaaacgtttcgcttcatcaacctcttcgatactggtgatcatcggcaataaaatacctaaattaccggtcccggcattagctctgagcattgctcttacctgaatcaaaaagatttcgggttgatccagggtgatacgaatgccgcgccagcccagacaagggttctcctcgctgataggcatgtaggggagctgcttatccgcaccgatatccaaggtacgcaaggtcacgggcttttgtggataaagctgtaacatgccttggtattgcgcaacttgctcttcttccgacgggaaaccactttgcaacataaacggtatttctgtgcggtacaggcctacaccatcaaccctccctcccagtaattgttcatgttctggactaaggcccgcgtttagcatcacctggatccgctcaccactttttagggccgcaggttgctcaacatcatcttcagccagtttactgagttcaatctcttcggtgaccagccgttggtactctttgaccagtaccggttcaggatcaactaatacttcgccacgataaccatcaacaatcagcagccgctggctgagtaatgcaggctggatatccgcccccatcactgtcgggatacccattgcccggaccaaaatagccgcatgagagttggcggcaccatcacgcaccacaacccccgccaagcggtcctgtggcacctcggcgagcaatgtcgcagtaagttcatcagcaaccaggataaagcgctcaggccactggctggctccagaggtactgtcatcaagatggaacaacaagcgttggcctaatgcccgcaggtcactagcacgctcgcgcatataggtatcttgcagactggcaaactgggcagcaaacgcctcaaccacctgtttaaccgcccactcagccaccgcgcctgcatcaatttgcgcaaatagctcacgctttaagcgagcatcatttagcaagtgggagtagagatcgaaaattgccgcactctctttttgtgaactggcggcaaagcgcttactgaagcgacgaaactcagccgcagcctcttccaaggcctgagtcagacgttcacgttcaagggtgctatcaagcgttgaggcctcatagaccagatcaagcgaaggctgtgagatatcttgccagccttctgccaccgcgacaccaggagccgccgccaatgcacggatccgtgtttggcgatactgaccaaaaatggcatttagctgagattgagaaaggatgcccgccaactgtgttgccagcgtgaccatgaacgactcttcgctctcatcaaactgacggtgctcacgctgttgaaccaccagcacaccaagcaactggcggcggtagataatgggcaccccgagaaacgcccgatagcgttcctctttgactagcgggacatatttaaaactgggatggctttgagcatcagccaggttaattggctcggccaaacgccccaccagcccaacgatcccctcgtcaaaagccagcgtgatagtacgcccacggggctttttcagccccctggtcgccattaggtagtaacaacggcggtcattgtctgccagataaatcgaacagacttccgtgtccatcgccagacaggtttcattgaccaacagctctaacgcctccgtcaggccggttgccatcgccactttctcaactacttctcgcaaacgcatgagcatgatcggcttaacttaacctcttttacggcgataagcgggcggtacccgtggaggagcgacctcctgcacaggcattacggttgcagcaaattctttcattacacgacgataaacgtcacgtttaaaagacaccacttgacgaaccggataccagtagctgacccaacgccagccatcaaattctggtgtactgctacgttgcatattaatctcggcttcgttacacattaactgtagtaagaaccaccgctgtttttggccgatacacaccggctttgtatcccaacgcaccaaacgttttggtaatttgtaacgcaaccaattacgggttgaagccaatatccgaacatcctttttgttcaatcctacttcttcaaaaagttcacggtacatcgcctgctcgggtgtctcaccgggatttattcccccttgaggaaactgccaagagtgctgtccatagcgcctggcccacaatacttcaccctgccgattacaaattacaatacccacattcgggcggtagccatcatcatcgatcaccggactacctcgataagctcaaaactcaaagatgctctgattgtttcacactagcaacaggcggtaaaccactgcttatcagccggccaaacctgataactttgggataactcacagatattggcaaagttataaacaccccagggagcggacttcgtattttattcactttttctgtggatataggtgtgcagaactcaaggagaaagcgggtacaactctttttaaagtaaaaatgtgccaaaaaataaaaaataaaaaaatcattaatttcaacaaaataacaggtttcccacagggatatattgcatgataatgtgatctatatccgtttccgatctggtgttgtttaaagatccatcaatgtagtttttatccacagataatgggtttaagttacgcaaaaaagagtaaaactcgcaaaaaagcctctcgtcaaggctgtaaattgaaccagtgttcatgatttactgaggttatccaataaatctgtggataaataggtataagatcctgttcattattgctgtcaacgcgtgcacaagataatcaaaataagaatattacctaagagcgggagcagaaaacttccgttaaatcatgctattattgctgtccgtttcactggattataatgcttgagcggtcatttttatttgagcttattttttaaccacttttagcgagtttttccgaatgtctgtttactctttgcctcctgctccccccagtgatgaacatcaactttttcaacgtgcgcaggcattgtctggttttacccttggtgaattagcaacacgtgcccagtgggtcatccccgcagacctaaaacgcgtaaaaggttgggttgggatgctgttggagttctatctaggcgccagtgctggcagtaaaccagagcaggatttcgccgatatcggcatcgagctgaaaaccatcccgatcagtgcacaaggaaaaccactggaaacgacattcgtctgcgtggcaccactcaccgggaatagcggtgtcacctgggaaaatagccatgtgcgtcataagcttgccagagtgttgtgggtgcccgtcgaaggtgaacggcatattccgttagcagaacgccgagtcggtgctccgctgctgtggagccctaatgtagaagaagaagagttactgcgccgcgattgggaagaactcatggatctgattgttttgggtaaagtcgaaagcatcacggctcgccatggtcaggtgttacagttgcgccccaaagcagccaatagccgggcattaacagaagccatcggtgaatttgggcagcctatcatgaccttgccacgtggcttttatctgaagaagacactgaccgcgccgatgctggctcgccactttttgctgtagcccagtcattccgattatgatcattaattcattacactaattgatacgttaataatgattaatacggtagtagtgattaattaaagcgggatgttctctatcccgcaggtgctttatatctcgctgatactttatatctcgctgatgctttatatctcactgatactttatatcccgcttttttccccacttttactttgcgctcttccccctgccccggtgcttcgttatagtcgaataaggcaggtttgacttatacctaaagtcattggcgttgagtcaacgcagctaacaacgctgcaacatcaaaaacgaagggtatgacctgacaatttcagacacaagattcagacacaaaggaaggtcggcaatgcaatatcatcgtatcccccacagttcattggaagtaagcctgctgggtctgggcaccatgacgtttggtgagcaaaacagtgaagccgatgcccacgctcaactggattatgccgttgcagccggtattaacttgattgataccgcagaaatgtacccggtgcctccaaggccagaaactcagggattaactgagcaatatattggtcgctggataaaagcacgcggttgccgcgaaaaaattattttagccagtaaagtctccgggccatcacgcggtgatgatcagcccattcgcccgaatatggcattggatcggaagaatatccgcatcgcgctggaagagagccttaagcgccttaataccgattatcttgatatttatcagttacattggcctcagcgggaaacaaactgtttcggtaagctgaattatcgctatagcgagcaaactgccgttgtgaccttgctggaaacactggaagccctgaacgagcaagtgcgggccggtaaaattcgttatatcggggtatccaatgaaacaccatggggtgtcatgcgttatctgcaactggcagaaaagcatgatctaccgcgtatcgtctctattcagaacccttacagcctgttaaaccgtagctttgaagtgggtctggcagagattagccagcacgaaggcgttgagttattagcttattccagcctggcttttggcacactgagcggcaaataccttaatggcgcgaaacctgccggtgcacgcaacaccttgttcagccgtttcacccgttactctgggccacaaacccaattagcggtggctgaatatgtgtcgctggcaaaacaccatgggctggatccggcgcagatggctctggcctttgtgcggcaacagccgtttgttgccagtacgctactcggcgcaacgtcgctggaacaactgaaaagtaatattgatagccaaaatatcgtgctgagtcaggaagtactggatgcactggaagcgatccatacccgctataccttccccgcaccttaaatcttgtcgtagcccctatcatccctatcataatatgaaggccgctgatgcggccttgaggttattgacaaagtgtcaacgacggagagaacaggcagatcgtaaagacgccgtaaatacatccatgtaggctcgagccgcgccctccctggcgcggacgctttactcccctgcctatcctcaccgtttcagatcgagtcatcggggcttgtcagcattctgaaggccgctgatgcggccttcagggtattgacaaagtgcccgcaacggagagaagaatagtttcatttttggtcaacgacgtaattgttgatgtcagtatttagtgggtgaaacgggtatgggaaatctcagatggaatcgtacatatatattattactgccatgaaaaagatgcgttatcagggctaaatgttaatctcgctttgctccattgttttccttcaagggcttgttctatacattgggcaggatataagtcatctgcaggttggaaattctgatactcagaatcagcggctatcttaaatttatgagaaatgtctagcctttgttttccgtcttcagtctggcactggatgcattcaataaaggcttcataaaattggtccggtaagccttcaagcatacatccttgcgcccagacaagtaattgctcaggagtgtgctttgttaactcgttcgctgtggaagttgaggttaaacggtgaagtgtattaaacagactcttggtcattattatatccctgttcagaaattgattaaaggcgacggcatgccggtttttaaatttcacaagcaaacatttttaatctttaatcaacaaaaacaagccgctttatctaaagaatataaatctcaggtgaagcaactcattgaagttaatataatcgatatttcaaaaggcgatatttgtcagcagtctgaaggatctccttgagatcctttcagatgacagacaaatcatatcattcaggctgacgcgttttctggcgctgttgccgccactgccagccccataacagagcaatagccagcgcgaataccacaccaaaaccgacacctaccgccacaacaggggcacctaatttgaccaccagcgagtaaagccccaacataaacagcatcgcggtattctcgcccaaattctgtacggcaatagcattcccagccccaacgctgtgtttaccacgctcctgtagcagcgcattgagtgggaccacaaagaaccctcccaaaatcccaatgataattaacagcaaataagccatcggcatactgttttgcagggagaagatggtgaccatcacgccaatcagcacgccagccggtaaacaacgcttcactgtttttagcgtcacaaaacgggcggcggcacccgcgcccaccacaatcccaatcgccaccatggcatttaacaaggttggtgtcgcattatcggcaatgccaagcgccacagggacccacagcactaacaggaagcgtaacgtcacaccggccccccaaaacaggctggtacccgccaatgagaagcgagtttcgctatcctgccagagaagacggcaagcggtgaagaagctgcccgtcatcgcccgtggacgccacgaagcgcctgaacgtgctgcggccaaacgtggaataaataaattggctattaccgcaatcgcatagaccaaggcgcaaacccctaatgcggccattaaatgccagtctgccagtatccccccggcaaccgagccaagtaagatcgcagcgatcgtcgaggcttccatcattccgtttgctttcaccaactgctcaccagaggttatttcccccagaatgccatatttagctggtgaataggctgccgctcccaccccaaccaggctatagcccagaaacggatttaaaccaaaacagataaccagagcgccagccaatttcaaaccattagccaccatcattacccggcctttggcgaaaccatcggcaatctgcccgacgaacggtgccagaacaatataagtcgcgacaaatgccatctgtaaaataggttggctccagtcgggataaagttgctgtttaatcaatgccaatgtggcaaacagcagggcattatccccgaaagcggagaaaaactgagcacagagtaccgcgaccatgctccgagataacaaaggcttatctgctaatacgtcctgactcatacgctcatctccggatcttgtgccattttgcccaacgtgacgaagtcaggtttaccgctgcctaataaggggagagctttcacgacccggatatcgcgcggcaccgccagttcaggcacaccattttcccgtgccgctttgattaaccgttcacgggttatctcactgtcagtggtaaacagcaccaatgcttcacctttcgcactgtcagttttagccgctgctgcatgttgcccttccggtgaaaggcttattgccaattgttcaacgctctccagtgataccatctccccagccaacttagcaaaacgtttcacccggccacggatcgcgcagaacccttgttcgtcgagggtcacaatatcaccggtgtcataccaattagcgtcaagttcaccctgagcattttctgctgatggctgctccaatacaccgggattctctacccgtaagtaaccacgcataatattagggccgcgtaattgtaagcggccaccttgagcaatccccggtacgttaatcaatcgggcttccatccccggtaaaatgcgccctaccgtgttcactttagccgccatcggtacgttaatcgccacaacgggcgcgcactcggttacgccatacccttccagaatacggataccaaatttatcctgccaaatctgtttggtactttcagccaacttttcagcgccagcaaccacataacgcacgcgggcgaaatcatatggatgagcaaagcgcgcataattccccaagaatgttgaggtcccaaagagcacggtacagttacggtcatataccagttcaggtaccacgcggtaatgcagcggactagggtaaaggaatactcggctaccggtcatcagtggtgtgaataatcccaccgtcagaccaaaagcatgaaacagcggcaatgatgacatgaagcgatcacgtggcgtgaagtcagcaatggttcggatttgttcgacgttagccaacaaactggcatgagaatgcaccacgcctttagggttgccttccgatccagaggtaaacaagattaacgcgctgtcatcagcctgctgcggcaacatcgccctacgcgggaaacacaagtggaataagatccacagcttatccgtcagtgtcaccgtgtcttttaaatcttccagatagacccagttcacctcattgacctgttccggcaggtgcgtcagtttgcctttttccaaaaactggcgcgaggtgacgatggttttaagtgaagccgcaatgatagcgctctgtagccctttagcacccgaggtgtagttgagcagtgccggaattcgtccacgtaacgatgcgccaaaaatagcagccgcagtaatggtggcattgggcagcaacatcccgacatgctcacccggcacggtaaagcgttgcaaaatacggctcacaccgagcgttttcttcagtagcgtctggtagctgtcctctttaaatgagacatcttcaatgcaaggtttaaagcgaccatagcgggtttgtgccgatagcaacgcttcaaacagcgtttcccgtggcaccgtggccatgcgggccgccatcataatggtatgcaggtgctcaccggccagaactcgccgttcgcgcgagcgtggcgcttgtggcataggaatggtggtggccggtaacacatgaatactgatttttgggaaccagcgtgtttttagcacgccctgcaatcgcccaaaatgagtaaattcagggccatctaaacggatagggaccaccgccgcacctgattttgccgcaacaaatgccgccccatcataaattttcatcaaggagccggtcacagtgatgcgcccttcagggaaaatgactactggcctgccctgttcgaccattctgaccagatgtttgatggccatcgggttggtcggatccagcgcaacaaaatccacataaggctttagccaacgcatataccaggtgtcagtaatactggtatagacagcaaatactggcttgatcggtagaaatagcgctaataaagccccatcgaggaaagagacgtgattgggcgtaataattaatttttcatgcttaaattggtcggtgacaccatcaatggtgacacggaataacccacgaaaaagagcacgcaataagcgataagccatgtctatatccctataactcaatgaatttgaaaaatagagaatactataataatggcgggtgtgtcgttaatagcacactaacaatatggttaggagagcgtacctaaaaaaaaacctacgcatctgcgtaggtcggtgcaaataaaaaacgatctttgatacacagcgaatgttgattattcaccaattaatacctctgggatcactactgtagcggcttatgtgaaaccacagccagcaaggaatcgcaacatttacgcgcaaagtgtaagcaggagtgaccattgtcaggaaagtgaaatgagtttgtaattcattaagatataaatggggtcaaccgtgagtagcatcgcatttcagccaccagagaaatacattcccaagtggctgtttggcgaatagaccctaaataattcgagctacaggaaggcggcaaacgaaagataatctactcataaagcgccacctcgaccaaacagctcatcgcatttgggccttgagtcaatcgagatgtcccaatatccagcgtcaatacatttgggttaccggattgttcaattttatgctgcgtgcccccaaaaccaggatcaaaccaggctccggttgccatcaataccaccccacgggtaaccccatcagtaatactgacccccgccagacagtgaccgcgtaagttgctaacctggacctgactaccttcggtaatatcacggctggccgcatccagcggatgcatatacagcgtttcacgacctgcggttttattgctctgagccaatggggcgggatcgagctgactgtgtaagcgatctcccggttgaatagagattaaatgtagcggccactgttcagccagcggagcgcccagccattcgaccggaggtttccactctgcatgaggtgcaaaatcgttgtattggtagctggcaattttttcactaaataattcaattttgccactcggggtctgtaatggattagcctgtgggtcttcacggaaagaatcaaagaacacaaatgctttggcgggagcaggtaaatcgacatacccttgttgccaaaaagtctcaaaatctggccattcaacatcatgagagcgctgtgccgcaccacactcctgataaatatgcctgatccacgccatttcatcacgaccctcggtaaaggtttcacggtagcccaatcggtcagccaagtcggcgaaaatatcaaaatcgtggcgcgcctgatgctgtggtgcaatcgcctgatgcatcgccaagacatagcgatccctggatgatccaccgatatcattacgctccagtgaactggtgactggcaggacgatatcggccatttttgctgcgggcgtccaccaaatgtcctgtacgatcacggtatccggtttttgccacccctcaaccaaccgattcaactgctgatgatgatggaacgggttcccacccgcccaatgcaccaaatgaatatccgggtaggtatgtgtttcaccctgaaattgatatggttgccccggttgtaacaacatgtcgcaaatccgtgccacaggaatagccaatccggcggggttcttacccactggcatggctggccccggtgtatcaatgcgcgggttacccacgccattcatcgaaccatgaccaaatgaaaaacccccacccggtagcccgacttgccccaacatggctgataatgcaatcaccatccaatacggttgctcaccacgatgcgcacgttgcaccgaatacgaacaggtcataaaactgcgcacaccgataagttgttgcgctaactgtgcgattctggccgcaggaataccggtaatgctgctcgcccagtctggagttttcgctatcccgtcattggccccacgaatataatcagccaattgaccataacccacacaatgggttgcaaggaatgcctcatcatgaccatcaaggcgctgaatttcataagccaacgccaacatcagcgcgacgtctgtattcggacgaatgggtatccattccgcgttaacaaatgcggggcaatcatcacgcatcgggctgatattaatgactggcgtccctttttgtgccagtttctctagccagagtttaagggaatgttcagccgacccaccggaggagacttgcgcatttttcagtgccagcccaccaaaagcaatgaacaattcacagtgttccaccacactgggccatgacgtcacccgcccggtcaatgggctaaaggtcccaatgacataaggcaggaaaaattgtgcagccccccaactgtaattacctaattgatcgacaccgccaccgccactgaaatagaaacgccgaactaatgagcgggcatgatgtaaacgccccgcagaagaccagccataagagccggtaaataacccagcaggcccgtattggtccctaacccggcgattctcttcggccactaaatccagcgccacatcccagtcgacttcaacaaaatcctcctgcccgcgtagagtccggtcactcttctcccgccgctttaaccaagaacggcggatggcgggtttacggatacgtttatcggagtaaaccatcggaacaattgagttcagtagcggcgagggatcgggatcatcggcaaatggctcgcagcggatcagcttgccatcttcaacaactgcggtataagcgccccaatgggcaagttgggggtaacggatgatggacatggctctctcaggcaatgaaataaaacatcaaggtaacattcgccaccgcacatactcaaagcaccatttcgactaaacatagtcatttggggcaatacacagccatttggggcaatacactgtcatttcggtcaatacacagccattttgggcgatggcgcgatagcaaacaaacgcggcaagccattctgctcatctccttttctttggtttttcttactaagttgcgaccatccccccttgcgggtaatcttattttccgcaaaactgagtgatgtaagcggttaccctaggatctctggaacaaaaatggccactataaaggatgttgccaagctggcgggtgtttccgtcgcaacggtatctcgtgttatcaatcattctcccaaagccagtgaagcatcacgcgtggcggtgtgcaaggcgatggaacaactgcaataccacccgaatgccaacgcccgagcactggcgcaacaatcgacagaaacggtcggtatgattgtgtctgatgtctcggaccctttcttcggtgcgatggtgaaagccgtcgaacaagtcgcgtatgccaccggtaatttcctgttaattggcaacggttaccatgatgccgaaaaagagcgtcaggccatcgaacaactcattcgccaccgctgcgctgcgctggtggtacatgccaaaaaattacccgatgacgaactgacgtcattaatggaacaaattcctggcatggtgttaattaaccgcaccttaccgggcttcgaaccccgttgtatcgcattagatgaccgctatggtgcctggctggcaactcgccatctcatccagcaggggcataaacgggtcgcgttcatttgctccaatcatcagatttccgatgcgcttgaccggatgcaaggctatttggatgcgttgaaagaatttgatatcccggttgatgagcgtttaattacctacggcacccccgacgaactcggcggtgagcaggcaatgactgatctacttggccgtggtaaacacttcaccgcggtaagctgttataacgactcaatggcggccggggcgttatcggttctcagtgataacagtattgatgtgccacaggagatttcactcatcggttttgatgatgtattaatctcccgttacctgcgcccacgcctgacgacaatccgttacccagtcgttgccatgtctacccaggccgctgagttggcactcgcattagccaacaacacaccgttacccgaaattaccaatatgttcagcccaacactggttcgccgccactctgtggccagcccgccaagcctacgggatgacactgattaaacgcgttccaggtcaatcaattcttcaatggtttgacggcggcggatcaagcgcggttggcccttttcaaacaatacttcaggtaataacgggcggctgttgtagttagatgacatcgacgcgccataagcccccgtatcatggaagaccagataatcgccaataaccgcagcaggcagagcaagggtctccacacctccgccctcttgctgagtgaagacatcgccagattcgcaaagcgggccagcaaccacggtatcaatcagcggagctgacgccaggtcgcgcccatccgcaggaagcaatgaaatatggtgataactgccatacatcgctgggcgcatcagatcgttaaacccggcatcaaccaagacataatgccggcggcccatatccttaacagcacgaacctgagcgatcaatacaccagactctgctaccaggaagcggcctggttcaatttcaaggctaaccgggtggcccaaatgagcagcaattcgctctctggcgctattccataacccataatagtgttcagtatcaatcacatcatcgccaaactgataggggatcgataacccaccgccagcagagatagcactgatatcgtgccctaaggtaatcacttgctgaaccatggcatcgcagacttgctcaaggtgttgataatcgacacccgagccaatatgcatatgaatccccaccagtgttaagccatagtgctcaattttcttgagtgcgcgagggagttcttcatgccaaatgccgtgtttgctgttttcaccgccggtattggttttctggctatgcccatgaccaaaacccggattgacgcgcagccaaacagggtgacccggagcctgttgccccagttgatccaacatatcgatagacccggcattgaccgggatattcaattcagtaacgcgcaataaggtcgcctgatccagtaaatcagccgtgaaaacaatttcggcaggttcctgccccggttgataacccgcgtgcaaggcacgctcgatttcacccaaagataccgaatcaaccttaacgccttgctcacgcatcaggcgcagtatatggatattcgaacaggctttttgcgcgaagcggataacatcaaaatggcgtaattgattaatacgctcagcaataatatcaccatcataggcccacaccgggcaaccaaaacgctcaggcaatgcaatcagattttgggcagtcagtgctgaagaacggtcattcagtgcgcgtggcataactatttcctaattgtgtagccattaatgtacgagctcatcaatgtgctgaataatgtattaaatgatgtacccaataatgggtggcggaaatgacgccgcgaatacctcattattaacgttgtggatttgttaggaaaatatctatttacccttagtctattcatttatgatatgggttaaattgatcagttcgcgtttcaggagtgctgagaatgcctgcaatttccttacgacaaatcgagatttttcatggcgtcatgaccacgggcaacctgactgaagcggcgttgttactgcaaacatcacaaccgactgtcagccgcgaattggcccgctttgagcaattggtgcaactcacgctttttgaacgggtacgtggccgcctttatcctaccgtgcaagggctacggctattcgaagaggttcagcgttcatattatggtttggatcgtatcaaacaggcggctgaaggtatccgccaatttcaacatgcccaactctccattgcctgcctgcccgtcttttctcaatcgttgctacccgcggtatgtaaaccctttattgaccgctatccagaggtcagcctaaatgtcattccgcaggagtcacctttattggaggagtggctttcagcccagcgtcatgacttaggattcacagaaaatacccaaacaccggcgggcacccagcgccataccctgatgacggtcaatgaagtttgcgtattacctgccgatcatccgttgcgggagaaatcggtgctgacaccacaggattttaacggggaaaattttgtcagcctgtcagtcaccgacagttaccgtcagctattggataacctgtttgcggaggaaaaagtcacccgccgattagtcatggagacccacagtgcggcatcggtttgcgccatggtgcgtgaaggggtgggggtatcgatagtcaacccccttaccgcactggattacctgagtaaaggccgtggttcgggggtttgtgtacggccattcagtgtcgacattccttttacggttagcttaattcagccattacatcgcccatcatccaccttggtcgatacgtttgtcgggcacttaaaacagcagacaacgcttttccaacagcgtctggcaacagtcattgcccctgcgtgctaagccattttattcccaatagtacgcgcgcgggaaaacgtaaacagacacagcaacaaccccatgaccgccagtgccgcggcggccagcggcaccgccgtcaaaccaagccctttggcaatcacaacccccccgacccacgcccctaaggcgttacccacattaaaggccgcaatattcagcgttgacaccagattaggggctttcttgccataagcgacgacattaatttgcaacgcaggcactgcagaaaatgcggcggctgaccacaaaaacagtgtcacttccgccgccaacagtgaataactggtccaactaaacagggcagaaaataccgcgatcaacaagaatgtcatggttaaactgaccgataaacgccagtcagctagcctgcccccgacgatattaccgagcgtcaagccaacccccattagcagtaacgtccaactgacgccatgctcagaaacctgtgtgacctccgtcaaaatgggggcgatgtaggtaaagagcgcaaacatggctgcggcaaaaaatacggtcatcagtaaggagagccaaattccaccgccacgcaaagcggcaatctccttacgaagctcagtcggtgcttcctcgctggaggagggcaacttgctatacagggctgccaacgagaacaaaccgatgaccgataccacccaaaatgtcgaacgccagccaaaagcctgacctagagcggtccccagtgggacacccaatacattcgccagcgtcagccccgtaaacatcagtgccaccgccgaggcccgccggtttggtgccaccagatttgcggcgaccaccgcgccgataccaaaaaaggccccatgacacaacgcggtgatcactcgcgcgaacatcaggaagtcataactgtatgccaaggcacacatcaggttaccgatgataaaaatcaccattaacagtaacagtgtcttcttgcgcggtaatttcgcggtcagcactgccatgatgggcgcgccaattgccacgcctagcgcataaccactgatcaaccagcccgcagttggaatcgatatgtgcaaatcacccgctacctggggcaataaccccataatgacaaattcagtagtaccaatagcaaaagcacacaacgccaacgccagtagtgcaacaggcataatacaagctcccagtcagacaatatccacccacactcagtggcaggcagatcaatttatcgccaataatggttaattaatggacacggtgtagtgggtagaattaagaggtaagacaatcaaagtcactgcttcaggtaaagagagaacggcgatctcaagtaacaaggatattacataaattgacgaatcataaccagttaatgaataacgttataaatagcctggtaagcaaaaacacgttaattcacacgctaagcatatgaaatattcaataacgctatgcaatcgctgataataaaaataggtttgacgatgtcataaaacggttcactctcttatcgataacacctcatgtcgacagcacctcatgtcgacagcacctcacttcattgtcgataaccacttaggatgtgtggcaaaccactcaaccagaaagtcgagcatcgttcttaatgtggttggcatttgtcggcgcgaagcataaaccccataaatacccatggcctgcggttgataatctggtaataacttaattaactcaccacgggcaatatatggcgctacagaatagatcggctgcaaggtgatacccgcgccttctaaagcgccactcagtaaaactaccgattcattcgcactcaaattgccactgacggcaaccgatgatttcacgcccgactgatcaaaatgccataaactctcaccgaagtaggagtacgtcaggcagttgtgtaccgttaaatcttgtgggctttcgggaataccgctgacagataaataagcgggtgaggcacagacgactgaataacacgttgaaagagggcgagcaattaagttggggtctaattcattggtaatccgtagcgccagatcaatacgttcttccactaaattgatcgcccggttattcatctgtaaatcaacagcgacctgtggatagcggcgtagatagtcagcaactgcaatagccagagcactctgcccaagagattgcgagcaactgatacgtagcaaaccgcgtaactcttcactttcctgcccctcagccagatccatatcctgagcaaactcaagcatacgtcgacagcgctcgagcgtcgcctcaccggcatgtgtcaggctcaatttacgggtggtccgatgcaataagcgcgcccccgcccattgctccatctgagccagatagcgtgtcgccattgccctggacatctccagtgactctgcggcggcaatcatactcccccgatccacaatcgcgacaaaaacctctgctgcagtgattctatccatgattcgctcgatttatgcaacaaataattgctcattatcgggtttttctatcgatatatgcaatctattatctatcacctaccccacggtcaataggacatcaaacatgttaaataaaatgctattacaaatcaccttcgcaagcctcgtgactgcttccgccatcgccacagccgctaccaccgagccattgaaaatggaagtctataaccctggtgaaaaaagtatcttcccagtgtcttctgaaattatcagtggaaaaaacgaagtggtactgattgatgcgcaatttcagcgtaatgatgccgaagccttggtaaaaaaaatccaacaaagcggtaaaaaattaaccaccatttatatcagtcaggcagaccccgatttctactttggtttggatgtcatcgctaaagccttcccacaagctaaggtgatcgcaacaccacaaactatcgaagaaattaaggcaaccaaagacgggaaaatggcgtattggggccctattctgaaagagaatgcgcccacagccgtgattattccacagcctctacaaggcaaaagcttcaccgtcgatgggcaacaaattgaagttgaaggcttagatggcccatcacctgaaaaaacctttgtctggatcccatcactgaaagcggtggttggtggtgtcgccgtctccggtaatatccatctatgggttgcggatacccaaactccggagtcacgcgagaattggttaacaacgttggaaaaaattaaagcactcaaaccggctatcgtcgtcccagggcacttcctcgataacgcgccacaaactttagaatcggtgacatttacccaaaactatttaacaacgttaaatgcggaaattcctaaagcaaaagactctgctgagctgatcgcggtgatgaagaagcattaccctgaactgaaagacgaatcaagtttggaattaagtgcaaaagtattgaaaaacgaaatgaaatggcctcagtaagaatcagttcatgtaaatgaggttattgacaaagtgcccgtagcgaagtgaatagcagcaaataaagacgccataaattgaatggctaaaaagaagcacagaggaacacagtatgcccggtacaacattgcactatattttcgacccgctatgtggatggtgctatggcgcggcccccttggtacaaacagcccaaaacattccaggcttgacgctggtattgcacggaggtggcatgatgtctggtgcaaaccgccgccaaattgatacccaatggcgcagctatgtcatgcctcatgataaacgtattgcagaattgaccggacagacttttggcgacaattatttcaaccaattactgaatgatacttcggcaataatggattctacgccccctattgccgccattttagcagcagaagcactggcgggtgatggagcaaaaatgctgcatcgtatccaactagcacattatgttgaaggccgccgtattgccgatacacccgtactaaccgtgctcgccgcagatattggcctgaatacagaggcttttatcaatgcttttaacattgcccaaaaacatactgcacaacatattgcggaaagccgaaccatgctagcaaaagtgcaagggcacggcttcccaacatttatattgcaagatgctgcaggcaagatgacagttgtacctgcaggcgattatttcggtaatcaaccgggttggatcaacaggttaactaacgcgtgaatcaatagcagcaatcgtgctctcctttgctaatcgtagaggagagtatttttctacaggtaaatgaaagcgggctaccgactgattaagctgtaaggtctgctgttgcaacacttccgatgcgtgtgctgattgctcaaccaatgctgcattctgttttgttgcgccattaatcatctctacctgcgcggccatctcctcaattcctttgctttgataatgtgatgcggtagttatttccgccattaaatcggtgactttcttcaccacatcaataatagcctgtaaattctcaccggaacgattaaccagcgaggcccccgtagaaactgagttggcagaatgctgaataaggcgcttaatattttgtgctgaatggccactttggtgagccaatgtaccgacctcacgtgccacaacagagaacccacggccgtgttcacccgcatgagcggcttcaattgctgcatttaatgccaaaatattggtctgaaaagcaaccgactcaataagtgtaataatttcgcttatctcccgtgaacccgtggaaatatcggccattgaactcaccacattagacatcatctctcctccctgactggccgtatctctagcttcattcaccagatgattcgcctgctcggcactcatggagttttgtttaaccctgacggtaagctgctgcatactttgcgccgtcaccgccaatgattgagtttgtgagtacgtttgttcagagagacgatggttatcagccgtaatctggttcacaccggtcaggatcacctcagctccacctcggacctggctaaccaatgcaactagcccctcttgcatatgtcttacactataagtgagttgtctaatttctcggcaagcaaaagacgtgtcttcaatacggtgtgataaatccccggcagcaatcttattgatacgtgagataaggtgatttaagggcgcaatcatccaacgggtgacgcctagccaggcagagaaagccagtaccaacaatatggccagtgcaccaataatgatctgtttagctgaagacagtgaggacaagagctgctcatccatagcagtgctgcccttttcactttcctgtaaatagcggtagtacttctcggtgaagtcgctctgaaagccctggataggcacgtcaaagaaggtgtcaatattgtgcttttgcgctaacccctgcgctatttcagccagcccctgatacaactgatggtagctctccttaagttcattcaattcttgtctactgtcttgggcggaaaccgcctgcaactgcagatagctgtcctgagattgctgcaatgactgcaatgcctcattgagaagactttgccaactgccttcggagccggtctctttatcttccatataatagatacccgcacgattaagcttgtcactggcaattaatagttccatccgcgcacgatccatcaacgcctcttgttgatgattacggtgcgttatctctacattcgctttggtactctttaaaatatgagataaataacctatggagaagatctgcaacaaagaaaatagactaatcactaaagtaaaaccaaataatattcccaatctagattcagaaagcgaaagtttactcataatgtagccaaaatattttttaacaacataattcatgcgtgaaaacatgttattcacattgggtcatgatagagatatccatgctagcagctcactatgacagatatatttcagcaatagcaccattatgctgtgatagttaaatgaagttaatgaagtcatttaatactcgtcataagttatcaatcacagccaccaccggttatatattggcacgaaccagtaatcgagtactgttaaccggatgcccttgagactgttcaatcaaaatagtattagcatccaaacgataaaaaattggataactcacatcataaggagtattaaggaagtcactaagcattttctcttcattatcaacaaaggaaatagacaacattttaacacagaaaacattattagcacttcggatattaaatagagtattgcatctggcttttacctggtcgcggtcatcataaacatctatagacgattgtatcgagcgattaataatattaacacgggaaaaaacatgataattaccactatcagttcttaataggtaatttccctcccagtagccttcaagatttttcatcggatgtatataggcataaatcataccaataattgtccccacccctcccccaaggagaatagaaaataatatcgaataaattattttttttcgcataccaactcgtctccctggcgtttacaaacaacatagccgccattttttttctttttcagtaaaacataaggatgctgctgataaacagataaaaacgttttatcttgttctttatccaaattaattaatatcggtaaagagttgacatctactaactttacttgataacggtacaaggccacattaaaaaatataaaaaagaaaataacaccaagtacaaataggcagactctataaaatgacatttttccttttaaaaaagacattgccattttatccacagacgaacctattattcccaatttttcataaggttgacattgaacttcaccctctatgaaaatttcaggtttaataccgatacgatacccctttttaggaatagtaaccactaactcgtgttttttatcatcaagtgcatgacgtagattactgatcgtctgagtcaatgtattatcagtaacataactcccctcccagagtctcttctcaatatcctcccttgatatcggctctggataatactcacaaagtaaagataatagctctgattctttgtttcttattttagttacctttccattcctatcaatcgttctcttttgtggcgtaaaaaaaacatcattaatcactatcgtattcattatattcttattgtttttggtttaaaatttcagcattgagtgtaatcctaacaaagaaaaactaattgtaattattaataaaacgattttttatatttaaaacaaaaatatgaaagatactgttttaacgatggttaatttaaataaatatatcgataaaaatacactaattataaattcaaaaaaaacataaaaaacaatctcatccattataatttgttattgtcaccatccttattctatgcttttattataaaacaattcatttacactagagataatcatgccaaattcaaatataaaattaatggtattttttgcacctatattatttggttgccaaataaatagtgaagaaaaaaaacctaacgaggagataatcaatcaactcaccgctctgacggctggattacgttttttaaaagaagactgcaacctcaaaaaaattccaaatgaacaagagatcattaactctgcaattaaaatagccaatctgaagggtgaaattatgacatctaaacataacaataagatcataaagaaaagtgaatctctatatcaagatatcaaatcagatttgactgctaaaaatactaagtgtctggagttagaggagctattaaccccatttattaagaaaataaattagtcacatgactcccaagaaacaggtatagaacacccgccaatgaaatataagggccaaatgcgatgtaattaatctcttttccattatcttttttatcaaaaaaataaaaaatagcatatgcgacaagaccaaaaaaggaagagaacaatattaaaaaaggtactgcactcacaccaaaccaagcacctaatgcggccattaatttaaaatcaccatagcccattccatcaacacctcttactattttaaacaaccaatatgatagccaaagaaaaaggtatccactgacagcacccagtactgcagaggttagtggtgcaaaaaccgtatctatattgataagaagaccaagccacagcaaaggtattgtcatacaatcaggaaggaggtaggtatcgaaatctataaatgccaatgccgtaagtgaccaaattagcaccaagctagtgcagataagtaagtcctctttaaaaatcataagaaccaagagtgtttgaatgacagctaatacttcaataaatagatagcgagtgcttatcttcttgttacaacaacgactggcaccacgcagaaaaatccaaccgagtatcggtatattatattttattggtattgactcattgcaatgatggcaaaaagagccgggttgaaataaattaatgtttctcaaatgagaacgcatcttaatttcttcaccgtgtgactcagatcgtgatgacaaattagtcagcataataggcaatctatagattaaaacattaagaaaactgcctaccatggccccaaaaattaaatagctcacaaaaaaaacctgtatatccatcatgtttacctctatcagaccgagtggttcatttaaagaatataatttttcctgcaacatacccatcatcatcatcttggtgaaggtatatatcagcactagatacattaatatcatatttatttgacacatcaatgatagcatcaagtaaatttgagaatttagctgaatttatttccacaaaacatttaccaccatcaagtaaggagacagtaaatattatatttttatttttaaatgatttatttatttcaatatcgataggatcactctttttatggctttttatgtttgattttttcgccatgatagagtgttgctgaagatgataacttagctcactatattttattaacagtttgttatttcttacttcaattactctactggtaatgtaatacacgataggaatagagataacaagcagataaagtagtagcactcttctctttgcagaaaataaatgctgtaaaaacatgacgtaactcatggttggctgcttagtttgatattatatttgtcttctccagaacgaatcacctcaaccctggcattaaatagattagttttatcatttagcatttcatttattaaatcatcatcaccttcaatatcaaaagatatttcaccatcagaataattgaaattaaaactacgtacatctacattttcatcagctgtataataacttacagcatttaataatttaatgaaactgacattgttttttttaagatccagatctgaaatatatttattgaagctcgtattaacatccccaccatgatatgcggggggtaaaaaatcagcataaaaatcttgtgctaccttacttaaggcccctgtatccctgactattttgtaaccttgataccaaccatttaaactcattactaaaaacaagagaaaaaaccaactggcaacacgcaaaaaaacactattgttaactattattctttcagcatatttatatttcccactcaatagattaacatgattaccactcacagtttttgccataattaatacaggatcactatagtctagcgactgccaattaccccatttaatatctgtcggactaaaagtattaactttaatggtgggttccgctaacataagtatgttttccaaaacactcgaattaactaaaaaaccagacatttcattatttctaaccaaccagttactctcaatttttataacactccattcactgttaaaaaagggcagagcaaaagcgtctggcattatgcaacatgctgatatcccatttatgtttaaccagaacaaccaacgattcatcaattcatgttcaatagcagcaacatggcaaaagtctttatcttgatctaatatcacaatatgaaaattatctatatcactagaaatagactgttcaatcgagaaggctatcgattttatattattcatcacttcatttttcttaatacttaagcttctgaaaatgattttatttgcggggaccaaaatcttgacaacattattagcatataaagttatattttttaactcagcgactccattaatttttccatgtctgactaatttctttccctgtgattcaacataccaatagataggttcaaattctgtttctcctagtcgaataaggagtgtgaaggttaatttcacgtcatcaatgatgttgctcactaaaactgtatctccggtttaaaatagctattgacttaccgacagcatggataaaagtaatcagttgataataactatcttcatgatcaattctaaatatataattaataaaatattcatctacagttaatttatctaaaatgtttttatttacatttctagcactcatgggtgaatgcgatgacaataaatcatagaatataaaaatgttatcccatccattattgggttttgctgaaataacatcataaatatctcttgcactgactttattgagtaaagcagcttgcagatactgactattccccgcatctagcatattgatgttaactaataatttcctatctcctcgaatacagagcattggtgctatttttaaaaaatcagcacgattcattttagatgaaatattaatttcatctacctcatatgaaatatattttaatgttgacaacccattattaccctgttcaataatgaggtttgaacgatataactcaaccactctgtccagggtatcctgtgtttcttgcactcctacaccgctaattaacaacaagtgtttaaaaacctgccatgaataagtttcaatgatttcttcgggattggaaattttagtttttaatgcattaatgttaaaacagtttgtattatcgattgatttaaggttaacgttccatgtacccgatgtaacccttccccctgatattaaacgtctaaaattattattattgaatctatcatctgaaatattttttattaattcactcacaaatttctcttcggcaccgagtaatatccatttttctttctgccgttgctgactattttttgccagataatagatatcgaaccaatagtgatatgatgtcattaccattgtactcatcaaaaatagtgcacataaaaccattagtaatgcaatgccattttgattcacagcgcttcctaatgtagcaatagaataaatcgcctaatcaccccaacacttttaacatcaagggtgatttcaatgccttgtggagaaaggtcaatcctactccattcatttaaccatttcccttgatgaaatactctcacacgaaaatcatttatcccttcgataaggcaagaaaatttagtctctactttatttgtattgtttaaaattaagtaagataatctttccaggcaatttttcttcactcgataaccgagtctttcctgctgataatgaataaatatctcagtgtttattttgttatttcttaacatatggataccaaaactgtcactatcaagtacgcctataccgataatacgttcttcattactaaaataatcattttgtaatcctgtagacatgactgaatgtgaaatatctcgttctaataggctaacaactctatgtaacctaataatttcttgtgctttattccccatgacattattgcttttaatggttattcttaaggatgaataaataataaaactaatcattgagaaaatgacaacggcaagtagcatctccagtaaagtaaatccacaatctggacgtttaatcattggttattttatagccttcaagtaaaaaatcaggatgttcactttctttattattacgtacttcaacaaaaatcatgtccattctatcatcctgaagttttatacttctcgattgccaatgccagattcgaccagccatagactcctgtcccatcaaccattcatttgtttgctctatttttaagattttaatttccgttaaaacattttccgcaacccaagaagagatcattctttgctcgagtatatttatccagcgtaagcgttcactaattattttcatgatactcaatccggcaatacaaaatattgtcagtgcaattattacttctaacaatgtaaaaccttttgtattattcagattgccccctattttatttatgaataaatagacttactcctgtaatattattttttatttcaacacactcactattttcttcatttcttaaaaccaaggagaagtccgaatactcctcctctggagagaaaaccaattgtggtttaatattatccccaatgacattatcaatgatactatcttcaccatagacattaagtttagatgttaatttatctggatactctctgcttagaatcttatcatttccggcatcttgccaaatacaatttattttagtgttaattttaaaattatcttttatgccatgacaatcatcgcaacaaaatttatagaatcgccagtgtgtctctgataattgcaacccaaacaccccgccttcatgtcgaattttctggttaatatatcgtaatccttgcacgaggttctcggcttcactcttcacgaccccgctgcctttaggcaatgttataagtacagagtagtagagtcctgagataattatcatggccaataataattcgagcaaagtaaacgctctctgactatggaacatggatctatgtctcactgatagataaagtaatccaattaccaatatcatcctcagtttccggtaacctatcaggtcctattgaaaatatatctatctggccatgttttcctgggttattcatttggtaagaattcccccatggatctgttggtaaacgccggatataaccatcggatggatatctctgcggtaatgggggaacgttgggtttagttactaaagcagcaatgccttgctgctcggtcggataatccccgttatctaatctatacatatctaatgcattttccagcgcactaatatcacttactgctttctgttggtccgccctatttttattagacatcagactgggtattgttaagctagcaagtaggcccagaataacaataaccaccataatttccaacaatgtaaatccttttgtttttttgtttgccattattccctcataaaattaattacatgacaaggctattaatttcaagtattggctgaagaattgacagaataacaaatgaaataaacgcggccataactataattatggttggctctaacaatgacattactatacttatttgattcatcagttcttcttcctggacacccgccacagtttctagcatatggtccaacttaccactacgctcccccgatatgatcatatgtaatatgatcggggggaatactccactatcaactaaagatgacgataaactacacccctcactgaccaatttaactgaaatgtttaacttattttttatatatacattcgttaataccgcattactaatactcattgcctgtacgattgtcacaccattagaatgtagtgttgttaatgttctaagataacgagatgtatttatacgaacaaacatattacccagcattggcaaacttaaatagtgcctatgaaaaaagacatttatcttatttatttttagtaatctatttaaaaaaatcactgccgagacacctatagccatgataaaaataacattttcttttatactataactgagtatcatcaatacttttgttgataatggtaacgccgtctctgaaaaagaaaactgctctactatgttcggtacaaccgctgtcaataatatgataatgacacttagtgatattaaaaccaacacacaagggtagataagtgcctgaatgatttttctttgtattttttgtgtctgctcaatatgatcagcaagacgaaccagcactaatcccagatgccctgatacctctccagcggtaaccatcgttttgtataatgggctaaatactgctggaaacggagatagcgcatcagcgaatgaatgcccttcctgtatattaactctaatcctttgaattatttcaatcattttacttttactattttgtttcccaaaaatatctaaaacctcatctagtggcattgaagcatttactaatgtcgctatctgccgtgtaattaataccaaatccgtcttattactattttttttgaccacatacttattaaaaagtaaaattcttttttttatacttaagacatgcatgttttttttgtaaaggagataacgggctatacgtatgttttccgcatcaatatcacctgttatcttggttccacttctgctgatggcaacatatttaaatacagccattatcatcctcttggcatattcttaccagttcctctatagtggttaaccctgcaataactttgcttatcccatcagatagaaggctgtttatagccccactggccaatttagccagttcaaactctcctagccctttataaatagccccccgcaataagttatccactacgagaaattcatggagagcaatacgtccacgataaccagtaagattacatttgttacaacctttagcccggtacaccgaaccaaccaaagagcatttatcatcaatattcagacgttgtaataccttctccgtcactgacgactcttggcgacacgctatacataatcttctaaccaaccgctgagatatgatggccaataatgaacttgaaagcataaatgcctctacattcatatccttcagtctggtcactgcacctatcgcactgttggcatgtaatgtagatagaactaaatggccggttagagaagcttggaccgctatctgtgccgtttcaatatcacgaatttcaccgataagaataacgtcaggatcttggcgtaatattgcccttaagctacgagcaaatgtcatttcaatttttgggtttacttgcgtttgggatataccaggtatgtcgaactcaatagggtcttctacagtcataatatttttctcattcgcgtcaatccccattaaagcagcatataacgtagtgcttttacccgaacccgttgggccaacaaccaagataatgccatggggtttatgtacctgcgtattcatagaaatacagttatctttcgacatacctaatgagggtaaatccaatttaatgctatttttgtcaagcaaacgcataacgacccgttcaccatggctagatggtaataccgaaacacgaacatccaatgctctacccgctaaatttagagctatgcgcccatcttgtggaatacgtttttctgcaatatctaatttggccatgacttttatacgcgacactaataatagtgcaacatggcgctgtaattccaatattttccttaacacaccatcaatacgaaatcttacagtaagttttttatcgaaagactctatgtgtatatcagatgctaactctttaattgcttcgaccagaatgctattgattaattttattacaggtgcttcatcatttatatccaataaatcatcatcgtcagataattcgttagcaaaagagtaaatgtcgatctcattgctgataacgctcattgtctgatatgggtcagccgaattattttggtagcgttcagttaaattattttcaaactcttcatcagtaactaaattaaaaagtattggactatgagccacccgattcccttcaagtatagcctccaatgtcgctgatttacgacaaatcaactgactgccctgtgccataggcagaataagcacaccatgactctttgaccaactaaacgttaatggcaaagtatggaactcagactcaatatctgtcatagctctgagtccaacagtgtataaaaattatttatatctttcctaatactaggaataacacttaaatattttttatctgataggactatatcatcggctaaagtatatccattcatattatcttttttatatttattatattcttttgacgtcacaacgctatagtcatcggattccctaagtattgtcggttttataaatagaataagattacttttttccactttctctttggtttgtctaaatagccatcctattaatgggagatcacccaagaaggggactttattaacaatcgtactagacttcttatcaagtaatccaccaacaacaactgtttctccacttttaactaatactgcattattcactactcgtttattaaaaacagaccctaaattatgtgtattaacagtagaactatcagcgatactcgacacctcttgcctgatttcaagtagaaccgaatcacctttatttatttgtggctttacttttagcatgacacctatagattgccttgaaattgaattatataccttatctgtggttgtcgtttgcgttgatatgagcactggaacctcctgacccacattgaattcagcctccatattatcgagagtaacaatactgggagttgcgagtatattattatttgtatttgttgataaagcgctaagcaatacatcccagtttcctttataaaaaccagcagttaatccagtaattgtcgtagctatgccccatccattattatttaataaaccatcggaatttttaataaaattaatatcatcagaacgcttattttcccatttaacaccaaggttaataccttctccgttttgagtttcgacaataatagcctcaaccaaaacctgtgcacgtctgatatctaatttttctattacttctcctaaggctagcatcatgtcaggatctgccgtaataactaatgcattcgtctgatcatatgcctttattgctacaggtctctgattccattgattagattgttttgtttttttctcattatgaaaaccttcgcttattccatttaagacatctaatagctttgaggcttgagcatatttcatataaaccacttttgtattcccatcgctactttgtcgcttgtcgagtttttttatcattagaatggatttttttctgatatatgtatcaccgctgattaatatagagtttgttctttcatcagcaataacctttcctactattgatacttcttgttttaaattatttattggatttatagcttcatttactattttaacaacatcagcagcaatcgcataattgagtttataaagctcaatttcattatctccggcttggtcaagatcagtaactattgaatgcagacggtttactaccgcagcacgccctgtaattaacaaaatattagatgggtcataattaataatactgccagactccgtattatcattgagttgcctcaataatggcgttattttctttgctgatatgtacctaagaggaataactctatttatcaattcatcaccatcgaatgttaccccctcttttgggagcggtgcgactactcctttggctctttttgatgaaatcactttgaggacattatgtggcatctcaatggccgcataaccatagacatcaagcacattcaagaatagttgataatacgtatctttatccaaagtctcataactgcgaatgctgataagcccttggaccgtaggatctatgataatagttttattaatattcttacttactgaattaataaactcttttatatccacatctttgaaagagactgaaaaattagcacttattatgtctaatggcataattagagtgaataaaaaaatcatcccatggatagatttaattcctttgccactaatatacatgatgttacaccatttattttagatggattgataaggctacgctctgaccagataaagtaaaaaacattttaaataacccattagttaattattaatgaataatatttaccattacgcttgataatcactctatcagtaaatatcttcactattactatatcttcataatttatattctcccttgttaaatgtgttgtttgctttccctttacttccaatattgcaatggactctgatggtgctgagtgttcaattacgccaaccagttttatttcccctatatattctggagaataaaaaagaacatcattcatttctatttttttatctggtttgtttattttacgatcaaacattttcgataagttactactgtctattaccttagccttttcggtagaattttgactatcgtaggactgcccattgtacaagataaacatatcattgctatcattataaataattgaccaaaaaaccatcactgtatgaaatgcaactagaaatacaatactcaattcaataaatataaattgattacagttgagtgtcctaaaaggattttttagtcttatctttaacaaaaaaaacctcattataaataatgatagcaaacatataataatgaaaaaatctggtgagtattatttattaataaccactaaatctctcattcatcttagtggacataactgttattaataaactcggatcaagtctaattccatatctatttattgttttaataatgccttcaggtatcccaaaacttttcaaatgcactctaaacttatgaattaattggtggtagttattatctgaaatacttttatggttttcgtaccagactacttttataatatcttgctttctatttacatcgttaaacaaacacataaccagtcttttttgtttctcattaatatcaatgctaacttttctcgtgtgaaaatggattttattcatacagcaatccaaagacatctctttttcataatcaatgactcctttaccattgatatcaatgaatttactaccagagacaacagaaaccgtatcaacatacatagataacccttaaaattattcattaaatttataacaaccgatcacgttaaagatgtgataaggaaatacgtgtttattatcgttgtcactcaatgaataaaaccaattaaattatgtattttaactatatttaatgaatatgaatgttttttaatcagctcacgaaggatttcgtttctctacaacatgattaataatatataaaaatcaaatagtaagaaataaagccttctaaagactgattaaataaataatatacagaaatatacttactgacatgttattattatttataatacttaaaatcagttttattcacttatgtaacaatagataatcacatgagtaaaatacaataataaaaataaatttcaagaaataaagttaattttcaaataactgtttaagtttataactaaaaacacagaataataacatcgcattggcatttaatttacacaacccatatgcttaacttattattttaatctaattcatatacaatcttttaactatcattcttgtgaagaatttatatttattcataaaatgaaacatataaggaatatatattttttcatgttgatcatataagcatatttttaaatttcggccaagcctaacaaaccaataaaaaaagaggaaggatgaataaattaatatcactaatagatatttgcactgattttccccttgagttatatcaaggggaaaggaaagaagggaaaagatcgaagttacactacatgaaaaattcaacttctccattatttaaattatacatacttccaacgattttaactttcccttcttgttctaacttcctgattatttcgctattcttacgaatttcatccatagtatttttgacgttggttttggctacggcatccacatatttttcattcttactgcttttttcaccatcaaattgggtcacttcaattgccggtttgattctattgagaagccccgtcagattacccagttcaacgttgtctatcgcgccttttattgcgccacaagcggtatgccccatcactagtataactttagcgccagccgccgcactggcaaattccaaactgccaattaaatcatcattagcaatattaccggcaactctagcattaaatgtctcaccgatccccgtatctaaaataatctctgccggtgctctggaatcgatacaactcaatatgactgctgctggaaattgcccttctgcactggcacgtttttgtgcgagataatcatgctgcagtgctttgccagatgtaaatcgcttgttaccctgctttaagctttcaactatctgatctggcgttaacttatcccgttcttcttgggtcaatgccgcagcataagatatttggggcaatcccagacctattcctccgataacgcctgcagcagtcatgcccaaggcagctttcaatacgcttcgtctactattgggatgattttcttctgaacaacaatccgttatcttactcatgagatctcctgaagtgattataaccctattgtatgccgggcatttaatgcacggcgttttaaaggtagtacaaattatttatatctacagtttattttcactaaataactcaaatagtgagccaagtaacaaaaaataagtaccgtgattacaacacgttgttcaatacgcgactgtgctctctcatcgactcagtccgttgcctgtaatgtctagcccaatgccattcccggtaaagcaagatccaagcctatttggtgatgagccaaaaaaattaatttaatcaacgggtcaattctcgtcagccactaaagcactattacatggcggataacttccttttccttacggtaaattgcaaaacgatgacttgttatgctcatcttcccgcaaaaccttcggttttttcgacttattgtcatcatcattcttattatttcgaaatgatattccaaagagttttatcggttaccgatagggagagtaaacaggacatgtataagacgattactgtgggctgtttggtggggttaatggtggcctggctaccccccgcggcgatacagcagtacgtaatgcagttcgaattgttggcgcaacgttggaaaacgtcacataccggggtgtcagaccagactttcgatgacaatcaactgaaagaaattgcgcgttatccagaatagcgctcagcaattccaatacactttgctgacagccacagatcgcgtgttctgggctgatgtaccattggatatggaggatatacaaagagatcacggcagcgtttagtgttgctgcaggggagcagctgactatctcaacggcaggattacacgggcaaccttaccgctttaccctagttgaatactgattgatcgttattgactgacggatatttgatgagatttaccgaatcgctccctagcggcttcttttggatgcaactttttacacgttctttcatttttgtgtgacaaacaccacccatacctttcgaactcttttttttgtgttttttttgtctattttcgaaaatatgtgatttcggttaataaattaacacctttcgatgtgttattttgtgatccatcgtaagcactcgaaagcatataaaggatatgatcacactcacagtacaagccttcaccaggttattaatcataaaaaagcgatttacctacaggccggtcaaaaaatttccggtaacggagctatcgatgctggaacctctcttcatatcccgcaatgtagcgtatttctataattacaaggattacatgtcattatgaaagcgaagttgttaatcacctctggaaagttgttagtcacctctggaactgcagcctgcctgggaattatggctgccttgatgcctgctgatgttcaggcagcacaagtgaatgcaaccctcagttgggtaacgggggattatggtacaacttacgattacagcggtccacgtctggatatgacgatcaacccagatggctctaactggtactacgatctcggttttcgtaagcagttgcatgatacggaccaacgttatcagcgtatggaagtaagtgccggctatcgtttccgttttgctgaaggttgggtccagcccagttttcgtctccgtgaagatttaagcacctatgcgagtggcaaccgcaccaccattaatttttatgatgccaaagttgcgggacaatatcagttatcagaacgtttcgcctttgtcggtaacatgatagtagggatggagcgcgaagaagcgaacaccgcgtctaacttagttgagcggaattctgatcgtctgtcctgggagattgagccaggtatccgttttaaatccagcgccaatacacagatgacactgaactattttaatgcaggtaaacgtagcgataagggtgaaacttgggggttatctgatgactcgaaaaaccaacaggtccgtttctacttcaactggaatacgccaattggtctggtgttaacaccttatgcacgttactccctggattatggtgaaacctctggctggtacgaaagtgcggcattcagtgaaacgaaaaccatgagtaaagttgatcgtttggcattacagttagcttacccattatcagatactttccgccttcaagccgaatattatattgaaaatgtgaaatatcaagaaggctatacaatgggtaaagatgactcacgggtgaaatacatgagagtaggtgtaagggcaacattctaaattaatgaatacacctttttacttaaagcggcactgatgtcatttgcagcttaaaataatctggccacacctctttacattcatttttattcctgtttattggaaggtaatgtcatgcataataaatttaaggcgaatactctcgccataagtatcgctgctattttattgtcggtctcttttaatacacttgccgtagtatgcccaccagaagcgccggctggcagtagttgtgatgcgttcatcgctaatgatggcaaggctgtgtcattagctaatgatttatatatcaccaatggaaatgcattaacttattcaggtaacactccctttgtagcacaatatttgcgtaaaaatattattgccaccggcacggatgcacacgctatttatgctgatgcaaacaccgtattcaacaataacattaacctcgaaagaggtattagtattatcagcgagaatggtacagcaattaaaattgacggttcattctctcacacagccgcagcacctaactttggtatagccgttaaagatggctctattgtgagagggaatggtgccgctatcgatttccgtgatgctcaaacagccattcgtatggatattaatggcagtatctatggcgatatcctgggtaatggggtcacaggaaataaaattaactttgcctatcaaggcgctgcagcgaatgccttattcgatggttatacaatttcaggtgttgaaaaattagaaaactggggcaacctgagtattattgcaaaagacagaaccatcacttggagtggtgattttacgaataaaaacaatgcatcccttgactttaaaattggtgatgaggtggatttagcatcgcccattttactcgttgaaggtaaaacagtatttaatacaggaagtaaagccctgttctcctatgtgggcagtaatattaatgacatcgtgaataaagatattatcctgatccagtccaatggtgggatgagcgggccaattgatgttgcccaaaatgaaatcaccgtggtcagcaacctctcgccgttattagcacagacagattcttgggtgacgacgacagaccccatagtgaacgggggaataagcggtaaccagttagtcgtacgttatggtgtgaactacgaaggtaccgataatttcctagacctggcacttcaaggtggagctaatcaatatcagctcaatgcagcgaattatattgtgagttatgcactcagccaatacaacaaaacccaatccgaagcgagtggtgaattactggcattactgacgtcagccggtaatagtagtgcaggtattgccagtatagccgatcagataacccctaatgcggaaggcggtgaagtccgggctgcattacggatggtagataaaatgcgcgatcaaatagataaccgcagcctctatttacgtaatcagtcagcagcaactccgtggaatttctgggcacaaaccttatacgcccacagccgtcaaagcagcgggacttatacaccgggatatcaaaccaatggctatggcattaatgtcggtgtagaccgccgttttaatgatgaatcactatttggtgtttctcttggctatcagaatgccaatattaacattcacagctatggcaatgaaaaagatgtcgatagctatgaacttatggcttataccggctggtttgatgatcgttacttcttcaatggtaacgtgaatatgggatataacagcaatagcagcacccgcaatattggtgaaaataccggttatcaagggaatacaaaagcaacggcagactataacagcttacaaatgggttatcaggtcaaggctggcatgacctttgatttggatgtggtgaaactacagccaagtgttgcctataactatcaatggcttcgtgtggatgactatgcagagttcggctcaccggccagtttggaagtggatcgccaatcttattcagtaaaacatttaggtgctggtttaaccgcatttaatacctatgagttaggaatgggtttattgacgccgtcactgacattaatgggttaccgtgacctgaatgacaccgagattattgtcaaaaaggccggattaaccacagatcaggggaaaggaaaaggccgttttatcgttgaaggtgatagcgtcggcaataatatttttgaagcaaaaatgaactctaatttgcagttaaaaaataatcttagtctggatggaaatattaattactacaaacgtggtgattataacgaaggctatatcggtctgagtgtttctaaacacttctaaaattttgtggtcagcagaaatagtgtcttcctcctctgatgaccacctttttattgggtagcgacgattatgtatgcaccatccaggttaaaacttattgctcttaccatgaccacattattaggtactgcggcttacacacctcacctttcggccaataatacaaaaagtgcgaaaacagaggtaagtcaaaaagcgctgatgcaatcttcgattattgatttcgatggcaatcagctccctgattttgtcaccgccagttcaggttcaaccttatcgctgagctccacccgctatattatgggtcaacagtcgcttaaatgggaatggcaggcaggcagtaccatgaccattgagcatcctattacactggtcaccgataaggtcgcctctaaaacctggggacgtaaagccacacaggtgctctctttttggatctataacgaaactccggtggatgattatatgatcgtcgatctggggcgagggctcggtccgtcaggcgcaccggatgccggtattaaagtcaaaatgaatttcagtggctggcgcaccgtgggcgtgtcactgcaaaatgatctggaagggcgagaaatcgaaggcattggtttcgatgataatgcagaaggtgaaagcggtggacgtagcacgatcgccggtggtgcgaaaagcgatatggacagcatccgttttcgggcaccgctaaaagcaccagcgggtatcttctatattgatcgcgttatgttgtctattgatgatgctcgctatcaatggtcagatgatcacgtcaaaacccgttatcagatcccggaaattaattttcgcttacccgccaaattacccgcaccaacggccggggaaatagcggcagctgatgacattcgtggtgcattgatccgcgtctttaccgaaggtcaaggtggtgagaatggcttggttgtggtcgataatcgcgagaaattacgcgcgcattttgcagcattaaaaattcaacgtgatgccgatgggcaattatcaggtcggcatattattacagataaacagaaggtgttatatcaaccagagtttatggatgatattgatcagcagcgtttcagcgattatgtgctcttgggtgattacaccacattaatgttcaatatcagccgagcctatcagcgcagcacatccgaagaggtgcgtcaggaactggctgacatgtatatcctgatgactcaacacctgttggatcaaggttatatggatggtagtgggctggtgacaacccaccactggggatacagctcacgctggtggtatatctcagccatgttaatggcaaacgaactggataagcatcaactacgtcagccagtttccgatgcgctgctgtggtattcccgtgaatttaaagccaactttgatatggttccggggccggaaagctcggatttggactatttcaacaccctatcccgtcaacatctggcgttgctgatgctggaatctgatccagccaaacgcgtggcattgcttaagcgttttggtgagtacatcaatgtggcactttcacagaccccaccggggggctacgacggcttgcggccagatggtacggcatggcgtcatgaaggcaactatccaggttactcattccctgcctttaaaaatgccggccaattagtatacatgctacatggcacaccgtttgcggtgagtgatgaagggcgagcggccctgaaaaaagccatgttatcggcatgggtctacagtaacccagcaacctcgttggggctggcgggccgtcatccgtttaactcttcaagtgtgactctgttccaagacgccttccgctggttggcactcacgggggatccgaaaaccggtgataaagtggataaagcgctggcggccgcttatctgcaaattaccgaaacaccagaaagtgagagtgaagcaatctttggtgtgcgcattgctccagcagagctcccccaaggaaactggacatttaacggcggtgcattcgggatccaccgcttcagcgacaagatggtgacgctgaaggcgtacaacagcaatgtctggtcatcagagatctattatcgtgataaccgttatggccgttatcagagtcatggtgcaatacaagtactcccgtatggtaaccagaaagagataggttttgtacaagatggctgggactggaatcgcaatccgggcacaaccacgatccaccttccattagctgaactggatagcccgaatacgcataccctgatgttacgtggtaatcatccattcagtggtcactcatcactaagtggcaaatatggcatgtttgcctttaaatttgatgcgccatctatgccgaagtttgacagcagttttaccgcgcgtaagagtgctctcgaaactgaaaatcggttagttctcttgggcagtaacatcagtaacaatacggaaaaatatgcgactgaaaccactctgttccaacatggcattacagataaagccagtgatctctgggtgaacggcgaacgtattacggcattgccttaccagcgcgcactggaggaaggtgattggttaattgatggccatggtaacggctatctactgaccaaaggggcgaaaggtgaagtacgccgccagcatcaggtttctgccaatgataaatcccgtgaccctactgaaggcaatttcagtctggcctggcttgatcacggggcgaaaccacagaatgcacaatacgaatatctgatggtgctagaggcaacaccggaaggcatgcaacaactggccacagattatcgggccggtaagaaagtgtatgaagtgttacgtcaagatgcctccgcacatattgtgcgtgataacgtgacgcagacaaccggttacgctgcctttagttctgtaacaccagatgagggtgtggtgaaaaatattgctcagccagccattgttatgacgcaaatgcagagtcatggtcagcttaagatcagcggcgttacgccagatctgaatatgacccgcacaacgaaagcgacgccattagcgattgccgtgacactcaacggccagtggcaggccacggagaataatccgcaggtgagcgtaaaacctgcgggagagaccacgcaactggtgtttaccagctactttggtatgccacaagaggtcacgctcaagccgatgaactagctctcggcgttacattatttctcagtgttacatgattaaaacatgactcagggcgcttcggcgccctgaggttattgacaaagtgcccgcgacggagagaacaggcagatcgtaaagacgccgtaaatacatccatgtaggctcgagccgcgccatccttggcgcggacgctttactcctctgcctatcctcaccgttcaagatcgcgtcatcggggtttgtcagcagtctgcgggcgcttaggcgcccttttactattacgtctaaatcataacacctgcgtctaagccatagcacctgcgcctgagtaataggcatttggatctgagtgataacattgcgtgtgatgatgaagagaccagcaggaataacacaagatccacgataacctcttcctgagcagattgtcaggaagaggaagtcagccgtcgatcagcgattaaagataagccttggccgcattggccgccacttctgttggccgccagacatcaccagagtgctccagccaagggattaactcgtcagcaatcaattgattcaccagcgccatattttctgcagcaatatttttcatctggtaaggatcatttttgttgtcatgcagagtataagtgagtggcttgccaactttacgatcaatgactaacgtataacggtctgtgcgcaccccgcgctgaccataagattgtccgccataaggcataaaagtatacaactgcgaggtaggacgtttatctcccggacgcccggcaaccgtattagagaaatccgtgccttcgatctgatccgggatgtgctcgctcatgcccatcagacccagtagcgtcggataaatatcgggggcggagaacagcaactcatcttcccgcaccggcagttttccaggccagcggaacatcataggaatacgcatcgattcttcgtaatgcacgttcttggttggctgaccgttagatcccatacagcaaccatgatcagagaagaagaccactagggtatctttatccagatttaggcgatccagctccgccacaatacggccaaattgctcatcgacaccgttcaccatcgccatatactctttaaagtattttggcccgtaaccgtcctgataggctttatcccatactacattcgggcgggtattcagagattctgaggtgtggtctttaaaacgatccaggtatttttgtggcacttgatcatacggtgaatgcggtgggttcatggagaccactaacgcgaagggttgatcgttatctcggtatttccccccctcattgcgcagatacttaatggcgatatcggcctcatgctccgggctccactggttaattttcaggggcttatcacgcggcgtgtcgttggtccaatacataggattgagatgtaaatcataagtcccgtaactgtaccaaaaatcgaagccgtggcgtttttcaggtggtgtccaatcattccagtaacgcccttccattgggttgttatagcttggcacaaagggggcttctggggcatcaagatgccatttgccaatgtagcccatgctgtatccctgttttttcaggatatcagaccacgtcaccgactcttttttaagttcaataccaaaatctttacccccaaaattgccatcagcccccgtgtggcagttgccttgtaagccattgcgataagggtattgtccggtcatgagcatgccacggaaaggggtacacagtggataattagacaccgcttgtttcaataccacactttgactggcgaattggttaatgaaaggggtaactgagggatcttgtcccataaatcccaaagattgggtacgcatttcatccgggaagataatcagtagatttggttgtttaccggtttttttcgcaggtactacggcctgagccgtactgagcacccccgtcgcggccgcggttgcccccaatgcgccagaaactgcgattccttttaataaattgcgtcttgttagcgacatgctgttactccagagagaaatagaaaatttctgttttaaagaatctagcggtatgacaagtgaaacggtttcattactggcggttcgctttctttttgaaaattaacatttcgataccgttcgataatcaccaatcgtaaacaaacaaaacaaaaaatgctgtgtttaggatcacaatgaaagattaaggtgctttacttaagtggggaaaaaaatatgaataggcaatacatcatgtgattgtggtgatgaaatacccagacccagcggcctcattaaataaaaaaccaatttaatcaaaatattacgttttttctcttgtttctacgcactcctatgtcatttgttttcgtttaaacatcaaccaatacattcatgcgataaatcaaaaggaggctaaaaaagaatatagcgagatataatgcgtaatgattttcgatttattaacgaatatcattatcgttattgattatttgttaaaagcaatcatactttttgtcatgagaggccagtcttcaggctggtatttcgtgaaaatcaactgctttatgtgttaagaatcacatttcaatctattgtttttacattattttattctttttatctttagaggatgtttttgatctaatatccccattgtcacgttattggaaagccggacagctacagatatgataaatatgtatgcgtaagttttcgcaaacaaaaaaccaataaaacgaagctttgtgaaagagatcataagttttgatctttctcattgaagataaacgtaagcgtagtaatcttaattcgaagccaaacgaataaaattcgactggtttcgtaaggggacagaagtgaaagcggcaatcgaaaggcgcatggaaatcttcaatatagtaacccagcaagggaaagctcgtgtcgaagatctagccgaaagattcaatgtctcaagtgtcaccattcgtagtgacctgagttttttagagaaaaacgggtacatcgtcagatcgcacggttcggctattccgaacaccggcgttatcgccgagctgactgtccatgaaaagcggcgccgtaattccggcgtgaaatcgctgattggtcaggcggcggcgaagctgattaacagtggtgacaccgtcattctggattcagggacaaccacacgggaaattgcggccaacttgaggtcggtagagaacgtagtggttatgacgaatggtcttgatgtggctatggagttagcatccgctcccggcgtggaagttctcatctccggtggtgtgttgcgtaagagtgcgatgtctttttctggttctcaagccgaagccagcctgaaaaactttcgttttgacaaagtttttctgggtgttgatggttttgacttgcgagttggtatcaccacatataatgagcaggaagcgagtcttaaccgcctaatgtgtgacatctcggaacaaattattgccgttgctgattcgaccaagtttgggaaacgcagctgccacatgattcgagagtttggtgatatcgatattttggtgacggattcggatattcctgaagagtatgtgcagcgactacgggatatgcgaattgaagtgatcatagctgaaaaagagaaataacaccttgactccatagtgacattattaatgttaattgtggagttaatgtatgcatcctttagaaaaactggttcagcgccataaagccggggaacaaattgggatttactcagtttgttctgcccatcctcttgtcattgaagctgcgctggagcaagcgttagaaaatgactcagaactgttaatcgaagccacctctaatcaggttgaccaatttggtggctacaccggtatgacgccggttgattttcgtgattacgtttttgctaaagctgatgctctgcatttccctctcgaaaaactcattttaggcggcgaccatttaggaccaaaccgttggcagcacttgcctgccaacgaagccatggcgcatgccgatgatctgatcgcggcgtatgtcgcggcgggcttcaaaaaaattcacctcgattgcagcatgtcctgcgcagatgatcccgttcccctctccgatgaaattgtagccgagcgtgctgcacgtctggccgccattgcagaagccacagaatatcaacacttcaatacacacaccgccgtttatgtcatcgggacagaagtgcctatccctggtggcgcgaccgaagagttggatgaaatcgaagtcacctcaccagaagccgcgcgtaaaacgattgaatgccaccaaaaagcatttgagaaatcaggtgttgctgagtgctggccacgggtgattggtctggtcgtgcagcctggtgttgagtttgatcacaccggtgtgattgatttctgtccagagaaagcccatgaactcagtaaagtcatggatgaatacgattatcaggtattcgaagcccactccaccgattatcagaccgatgatgcctatcgcgcactggttaaaggccattttgccattctgaaagtaggcccggcgctgacctttgctctgcgtgaagccctgttcagtttatgtcatatcgaagaagagttattcccggcagagcagtgctcccgcctccgtcaggtgatggaagacgtaatgctgaaatcgccggaatactggaaaaaatattacctcggtgatactgagcaagtgcgcttagcccgcgtttacagtttcagtgaccgcatgcgctattactggccaatggaagccgtgcaggctgcacaagaaaaactgtttgccaatctgaatagtgcaccgattccgctaccactcttgagccagtacatgccacgccaatttactgcagttcgcgaaggcactctgtcttttgaagcgacggcattggtcaaacaacaaatcaaaaatacgcttattggctatgtcaatgcatgccacctttttaacgggaacacatcgaaatgacgcaatatttagggtacagccgggaagaactgactcgcttacatgccagttggaccgcacaggaaattgaacaacagcctgcatgttggggaaaaacacagcgtattgtggaagagagtcaggcagcgattaatgattttctgcatcaggcattagccgcgagtaacacgcggattatttttaccggtgctggaacctcagcctttgccgggcgagcgctggctccgctgttagcaccttatctgtcccatcggattgaagcgattgcgacaacggatttggtggcaacaccagaacaatatttctccgaagatattccgacgctgctggtttcatttgcccgttccggcaacagcccggaaagtgtggctgcgttacaagtggcatctgcctgtttatctcgctgttttcacttggtattgacctgtaaccagggcggccagttatatcaatattgccagacggcaccaggtgcattggccgtgctgatgccagcagaaaccaatgaccaatcactggcgatgacctccagtttctcctccatgatgatggctgcgatggctatttttgctggaattgataagtattcgaaagaaattgaaagattttgtaagggatctgcggattggttcaaagaaattaatcataaaatcatcgataatactaaaagttcgcaataccaaagggttatctacttaggtagtggcggactacaggggctggcccaagagtcagcactgaaattactcgaattaaccgcaggtaaagttgtggctacttttgatactccgttgggattccgccatggtccgaaatcaatcgttaatccggacactttggttgttgtttacatctctaatgatccctacacgcgtcaatatgatctcgacctgttagctgagatccgcgccaacaacgttgccggtaaggttatcgctatcgcagcacaatcagatgcttatgtcacagctggtgaccatgttctggtacctggtatggcagaaagttctgacttaggcctgctgtttgcctatctgatgtttgcacaatccttcgcttttcatagctcagttgccttaaacaacacgccggatagcccatctccaacgggtgaaatcaatcgcgtggtgcaaggtgtgactatttatccatttaaaaaataacacacaggaatatccctatgactcggccaaatatcgtctggactcgtattgatgagcgtttacttcatggacagatccgcattacctggggaaagcacaccgaagccaatttaattctggtggccaatgatgacgctgccgatggcccaaactcggctttcatgcaggcgggaatgaaagcctccgctggcggtgaatatgcagtgcgctttttcagtatccagaaaacaattgatgtcatccataaagcctctcctcagcagaaggttttcattctgtgtaactccccgacggatgttgcgcgtttggtcgaaggtggtgtgccaattactcagtgcaacgtgggcaatatgcactaccacgacggtaaacgtcagattgccaaaacagtctctgtggatgaaaaagatctggacgctttccaacgtatggccgcgcttggcgtggcctgtacggtgcagaacacaccagaccaaacgccaatcaatgtgattgagctggccgccagggcataaatcgacgacttattacgccaagacatagggaattaaaggataaattatgctttttgaagctacgttagtcggaatctgggccttcttgtgcggtatcgacaagtatgacgttgccctgaatattcaccgcccgttgatcaccggcccagttgtcggtttgatcatgggcaatatggaagtgggtttaatcgcaggtgcaacactggagctggcttggctcggcctggtaccgaatgcgggggcgcagccacccgatgtgaccatggggactatcgccgcagttgcctttgcggtgatgaccggccagtcgccagaagtggcaatgggcgttggtatgccaattgcggtcctgatgcagatgattattatcggtttctttgccatgacagcgttcaccatgggcagagcagataagtatgcagagcaggcagatacggcgggcatatcgcgcttgttgataggcacgctactcacccggtcgatgctctattttgtgatcgcctttgtcaccgtctacttcggtgaacatgcggcaacctggattgatgaaaatacaccaaccgccctgttagaaggcttaggtatcggtgcgaagatggttccggcaatcggctttgctatgttgctgaaaattatgtggtcgaaagaagtggctggtgtgttctttatcggctttgtgatgacgacttacctgaaactgccaatcatggctatcgccattctgggtgctgctgttgctgtcctgtactacttcttcagtggcaacaataacggcagcaataacaacggtaacaacaccaacaaacaaccagaggatttcgaagatggcatctgatatcaccgtagataaagaccacacggcaaaagcgaaaacggacagcctggtggacaaaattgattcctatcaggatcttgaagttcgtaaagtggttacccgtaaagatctgtggaagtgcgccatccgtggcctgttcatggaaggtaactttaacttcgaacgtatgcaagccggtggttttgcttattcgatgatccccgcgttgaagaaaatccacggtaacaaccgtgcagatttggcgaaatcgctaaagaaccatttgcagttctttaatgccagtccaaagctgttcaccttcctgttaggcactgcggtggcgatggaagagaacaaagaaaagccctcaatgatcaacgtaatgaaagttgcgggcatggggccaacaggcggtatcggcgatgccattgaccacatgacgctgatgccactgacgctggcgctgggggcttctattgcgattgaaggctccatcgctggcccatttgtgttcttcattctgtaccagactgtgcacttcttggtctatttcggcctgatgtttatgggctaccgcgcgggcacggcggcaatggtgaacatgggggatgccacggagaaactggcaaaagccgccaatatcatgggtatctttgttatcggcgcgttgtgcgccacctttatcaggctacaaactaccgcggcgatagatcttggcgggaaaacagtggagctacaaaccgccctgtttgacaagatcatgccgaatttactcccgctggcattggtgttctttatgttcaagatggtgaaaggcacgggtttctgggcgaaaccaccggtgttgattttctccacgctggcggccggggtcgtcggtcatctgctgggcattgtctaaccgttatcgccatcgccgcatcgtggctttgcatgatgcggcgtaacagagcagcctgaatatccaggcagtaaggatgttgtaaatgattgggattgttgtttctggccacattaattttgcttctggtatggcttccgcagtacgggcgattaccggtgagcaatctcaaatgctgttcattgatttcgttgaaagtatgtcaacagatatgctggaaagcgaactgcgccgtgcggcacatgaggtagacagcggcgaaggtgtactgtttttaaccgatattcccggtggctcaccttgtaatcgcgcactgaatattttgatgagcggcagcaacgttgagctgcttgccggggttaacctgccaatgattgcgaatgccgcctttgaacgtgaaggggcttcactgtcagagctggtcgaaatactgatggatattggcgcgtccagtgtacaaaacctacgggctgagctggataccgctctggttactgatagcggcgaaaacgaggatgggctctaattatgcgtactgcctatctcgctgatcgcacttttactccgcaaggcattgaaaccggtgtcgcggttatcgtcgagcaaggcgagattgtggcagtaacacgcgagctgccagcggatgcagaaattgtgcatctgacagggaaaaccctgatcccaggtctgatcgacattcatattcatggtcgccagggggcggatgtcatggatgcctctgcggaggcattacgcaccattgcccgtgccctaccccaaaccggggttgttgcctgggtcggcaccaccgtcagtgcgccgatacaggatatctttgcggctctggcgcaggtgcgtgattttattgcagacccggataacgcacgtgatacccgcaccgcaaccctgctcggcagttttctggaggggccatatttcaccgcgcctttccggggttcacacccagaaaagtatctgacgacaccaacaccacaagagctggagcaattacggcattcggcgggtaacaccttgttgcgtgcagctatcgcacctgagtcacccgaggctttggccgcgatccgctggctggtgaatcacgggatcaaaacctctgtggcgcacactgcggctaattttgagcaagtgacggcggcctatcagcaaggtgcggattgcggcgtacatttgtataacggcatgtcagggttgcatcaccgtgaaccgggctgctgtggtgccgtgttgtatcacgacatgctggcagagctgattgccgatggcattcatgtgcatccggtgatgatgaatctggcgtatcgcatgaaaggttatcgccgcattgcactgatcaccgactgcatgcgcgcaggggggctgggtgaggggcgttatttactcggcgcacagcatatcacggtacgtcagggggaagcgcgcaccgatgatggttcactggcaggcagtacctgtagcttggatcaggcgctgcgtaacatgatccaacatgcgcaagtccccgagtgggaagctgtacaaatggccagcgcagtacccgccgcttatctgggattagcgtcaacactgggttcgatccagatgggtgcgcaagccagcatggtggtgatggagagcgactttaccgttgccgcaaccctgattaaaggtgaatgggcttatcgccactcagcctaagtgccgtgctgctcacggccgggatcctctgccgatcgcttcactgacataacgccttttatgcttatttacacctcatagatttcagaatgtggtcaacacatctgccttctgaaaagtaactcaatatcagcatggtgccgccgttgtgatgggcggtaggcatcgtgcgccctaattataggaagacataacatgcaactatttgatttgaatggaaaagtagcaattatcaccggatgtaatacggggttgggccaaggcatggccatcggcctggcaaaagccggtgcagatattgttggtgtgggagtcgctgaagccccggaaacccaggcacaggttgaagcactggggcgtaaattccacttcatcactgctgacctgatacaacaaaaagacattgatagcatcgtcagtcaggcggtggaagtgatggggcatattgatattctgatcaacaacgccgggatcattcgtcgtcaggacctgctggagtttggcaacaaagattgggacgatgtgatcaatattaaccagaaaaccgtgttcttcctgtcgcaagccgtggcgaaacagtttgtgaagcagggcaacggcggcaagatcatcaatatcgcctccatgttgtcattccagggggggatccgcgtgccctcttacaccgccagtaaatccgccgtcatgggcttaacccgtgcattggcgacagagctgtcgcagtacaatattaacgtaaacgcgattgcgccgggttatatggcaaccgataacaccgccgcactgcgcgcagacaccgcccgcaacgaggctattttagagcggatccccgcgtcccgttggggaacaccggatgatttagcgggcccggcgattttcctttcgtcctctgccagcgactatgtgaccgggtatacattagcagtggatggcggctggctggcgcgttaagtaagggagcatcacatgagcaatatgacacagcagacgcgtactcaacaggcgcgtgaaacaatgaagcgggtatatcgctatcaggcagcaaaccaaacacgtagtgtgatccgtcggagtggcaagacgcgttttattaaagacacagactgggagcgtggtgtgttctggtcatgcgttgccgccgcttggctggcaaccgatgacgccgagtatctggagggcgtcatgaattacacgctgcataccgggttccgccctggacccaatctgcgctttgccgatgacctgatttgctgtcaggcctatctggatgtctggccgcagatagccgtaccggaagcattagagccaaccatcaaagccgtctctgccatggtggacgaaccaaagccggggcgtgaagattggtggtggtgtgactcattgtttatggcccccgccacctttgcagcattgagccaacgtaccggtgacgcccgttatctggcttatatggacaccgcattctgggatgcagttgattatctgcgcgaccctgacagcggtttgttctaccgcgatcatcgctatattcctgacggtaccggcactgaactgcgtgaagaaaatggcgagaaagtgttctggagccggggtattggctgggtactggctgccatcccacgcctgctcgcgcggatgccagaagattataccggtcgtcagcgttatctcgatctgtttactgatctggcagataacgtgatccgttaccagcaagcggatggtttatggcgtaccagtctgctcgatcctcagcggtttcctgccccagagagcagtgcaacagcgctgttttgttacgggctgagctggggaattaaccaaggtattctggcaccagaaacctatctgcccgtggtggaaaaagcctgggatgccctgcaaggctgtatccacgataacggcatgatgggttgggttcagctaccggcctttaatccgcgtgatgtgaaatttgagcacaacatggattatggcgcgggggcttatttattggccgcgtcggaaatgttacgtctggcctaacaaggttgttctgtttgcccgttcgcgggggaactcagtagccgtgatgtgttattcattttgttgcactggcgcacatcacctgatgtgcgtgaggttattgacaaagtgcccgcgacggagagaacaggcagatcgtaaagacgccgtaaatacatccatgtaggctcgagccgcgccatccttggcgcggacgctttactcctctgcctatcctcaccgttcaagatcgcgtcatcggggtttgtcagcagtctggcgcacatcacctgatgtgcgttttttataggcgatattttggttaactatcttccgaattcttgcgaatatattgcgttaactttcatatatgtgattcagcgccttttagttctctttttatttgcgtaaattagtcagtattgtttcactttctcggaacacctatctgatggcacagccacatactcaacaagcctattttcacatgatggccaagcccaccagctatcgttgtaatttggattgtgaatactgtttttatcttgaaaaagagacggtactccctccccagaaaaatccctcaccgaccatgagcgacagcatgttacggcgctatgtgcgtgattacttgcgttctcatgccggggatacggttgattttgcctggcaaggtggcgaaccaacgctggccgggctggatttttatcgtaaggcggtggaataccaacagcactatgcaaacggtaaaactgttacaaacagctttcaaaccaacggcattgccattaatcgccagtgggccgcattttttgccgaacaccgttttctgattggtctgtcggtggatggccttgaagcggtacatgataaataccgtattgccgtaaatggtcaacccacctttgcccgcgtgaagaaagcgcttgatctgctgcgtgaatatcaggtggatttcaatacgttaaccgtggtgaatgatcaaaactgggataaaggacgtgaaacctatcaggcgctgaaagcgctggggtcaacctttatgcaatttattccgattgtggaagtggatacccgttgcctatcgcggacaacaggccattactcaccgccagccaaccctcccatggctccctttactgtgcctgcggcgggatatgggcgttttatgaatgacgtgtttgatgcctgggtgacggaggatgtgggaaccgtctatgtccgtgaatttgacagtttgctcgggacctggatgggctaccccgccgctagctgcatacagtcggtgacctgtggtcaggcgctgatcatcgaagcgaatggggatatctacagctgtgatcactatgtgtacccagcgcatcgtttgggcaacattgctgacacctcgctagtgaaattagcgacatctcgccaacagcaacgctttggtgatgccaagcaggaaaaactgacacaggcgtgtattcgctgtgaagtgaaagcgctttgtcaggggggttgcccgaagcaccgcatcatggcgttgccagatgaaaaacataagcacaattacctctgcgcctcctataaacacttttttactcacaccgccccgttgatgcaggccatgtgccagattattcaacgcgggggcattgctgcggacattatgccgcaactgacacagcctaaataacgcttgaggaacacataataatgaagttacccgcaggaaaaagaagcctgttggcagggatgatcgctgccgctggtatgagtatgacacctgtgactctggcggcaccggcagaaaaacccaatgtattgctggtaatcatggatgatctgggtaccgggcagttagatttcaccctcaataatctggataaaaaagcactaagccagcgcccagttcccgtgcgctatcaaggcgatctggacaagatgatcgatgcggcacagcgggcgatgccgcatgtgtctttgttggccaaaaacggggtcaaaatgaccaatgcgtttgtggcgcatccggtatgcgggccttcgcgcgcgggtatttatacaggtcgccacccaaccagttttggtacttacagtaatgatgatgccatgcaggggatcccactggatattaaactgctgcccgccttgtttcaggagcatggctatgcaaccgcaaatatcgggaaatggcacaacgcacgcatagagaaaaaagcgttcgtcgccgatgaggtcaaaagccgcgattatcacgacaacatgatctccgtcagcgcccccggatatgcacctgaaaaacggggttttgactattcctacagttattacgcctcaggcgcggcattgtggcactctccggccatctggcaaaacagtaaaaatattgccgccccaggctatctgacccataacctgacggatgaaacgctgaaatttattgatgactcagggaaaaaaccgtttttcatcagcctggcttacagcgtgccacatattccattagagcaagcatcacccgcgaaatatatggatcggtttaataccggcaacgttgaagcagataaatattttgctgccattaatgccgcagacgaggggattggtagaattgttcagcacttacaagaaaaaggtgagctggataacacactgattttcttcatttcggataacggggcggttcatgaatccccaatgccaatgaatggcatggaccgtggacataaaggacaaatgtataacgggggggtgcatattcccttcgtcgcttactggccaaaacagatccccgcaggtacgcaaagtgatgcattggtgagtgcattagatattttaccgacggcattgaaagccgcgggtattgccatcccagcggagatgagagtggatggtaaagatattctgccggtactggcaggtaaggaacaaacctcgccgcatcaatatatgtactgggctgggccgggggcaaagcattacagcgatgagaatcagtcattctggcatgactactggaaatggatcacttacgaacatcaacaggcgcctaaaaatgatcatgtagagacattatcgaaagcctcttgggcaatccgcgatcaggagtgggcgctctacttctatgatgacggcaccaatacgccaaaattatttaatgataagcatgatcccatggaatcaaaggatttagctgatcagtaccctgagcgtgtcagtgcaatgaaagcggcattctatgattggatcaaagataaacccaaacccgtggcttgggggcaagatcgctatcagatcttagcaagctccgcgaaaagttaagctcgtgcggtgtaacggggagataaggtggagcgagtgttcttagccccctcttttatcccctcttacccctctttttattaccgttctccttatcctagtgacttgcaggaacactgctcatgagtgttgatattagcgccaaaccccgtccgatcattccttatgaacatcctaatgcggcgatgtattaccagttgtttaaacaacatatgatccgccagtggcataaaaaacggccttatgcgagacatgatgcgcgcttacaagccctgtttcagaatcaaaaggtgtcgctgcaaagccagtgtgattacctggtgcgttatgtggctgaagcatttgatcattatgccgtctgggattatacccatgcttattatccggggcgccccagccagcaaaatgcgcgcacggatgcactggaaggcgtaagccgtgtcctgccgacgctagcggcctggttacacagccaacctacggggctggataatacgcgacttgctgatctgaaaggcggggagctcgacattgtggctatcttacgtcgcgcgttcttagccgggactgacccgacccatcgtggatattggggcacgctgcatgattatgatcagcgtatttgtgaaagtgcagacttggcattggctttatggttgagccgtgagtcggtctggcaggcgtttacgccaccagaacagcaacaagtgacacgctggttcagccaggttaatacgctgcaaacggtggataataactggcatctcttcccgttaacggttcagtttgtgatgcgatcactgaacggcactggcgatatcagtgatgataaataccagcgcatcaaagagttccatgtcggtgaaggctggtttcgcgacggatcacaaggcaattatgattactataacgcttggggattccactactctctctattggctcgatcaaataaatccggattatgaccgacagtttattcgttcctgcatggcagaattcgtcgccgcttatcgctatctgatcaccccacaagggatccccttctttggccgtagtgcctgttatcgcctggcggtatcagcgccgttactggcggtggccagtcactcaacagaccccgttcataccggtgaagccaaaagagcattagaagccacactgcgttatttcattggtcacggagccatgcgcttcggtgctcccacacagggattattcgcagatgatgaaaggctggtggacaactacagtgggccagctagcagtttttggtcactgcgggcgttgaatattgcgctgtattgcgccaatgactgtgggttatggcagtgtgaaagtagcaaattacctgtcgagaccgaggattttagtttcactattaatgccatcgatctctttgttatgggaactttcgaaacgaaagaggtggttgttacttttcgtcatgattacaccaaagagcagacaccactgacccgtcgtttagtgtcacaaccgtggttagagcgtgtgaaagagaacgttactggccgtgctgaacggccgaaaaacaatttactccgcaaaggcgtaaccagctacagctcaaaaatgacgtcactcttttaactgcgtttactttcgatgtgatgcaaatctcttttatttgatttctttttgtttgtgtaagcttttttttatggttaaatgaaaggaaatgaaatcacggaggttgagttatgtttttggtttcttcccgagaaatgttacgtcaggcacagatcggaggctacgcaatcccagccttcaacatccataatctggagaccattcaagccgtagttgaaacagcggctgaaatggcttctccggtcattttggccggaacaccgagcaccttttcttatgcgggcacggaatatctggtgcagatctgccaacaagcggcacgtcattaccgtatgccttttgcactgcatctggatcaccatgagtcgtatgatgatattacccagaaagtcgcggcgggcatcaaatccataatgattgatggctcgcattttaactttgagcaaaatatcgcgctgacacgtcaggtggtggagtattgccatcgctgggatggtactgtcgaagccgaactggggcgtctgggcggtcaggaggatgatctcacggttgatgagaaagatgcgctgtataccgatcctggttcggcagcacattttattcaggcgacagggatagactctctggccattgccatcggcactgcccatgggatgtacaaagaggcccctcgcctggactttgatcgtctggcgctcattcgccgcaatacggatatccctctggtactgcatggcggatcagggatcccagatgaagatgtgcgtcgttgcattgaattggggatcagtaaagtgaatgtgggtacagagctaaagatcgcattctctggtgcactgaaagcctatttccttgaaaataaaggcgcgaatgatccccgtcactatatggttccggccaaagccgccatgaaaaaagtgattcaggataaaattaacgtctgcggcagcgctggcaaacggtaaagcgccaggagaggaagcagattatgacgaaacacgttgccgtattgctggctcacggttttgaagaggcagaagccgttatttttatcgacatcatgcgtcgtctggatatccgggttgatattctctcctgcgaagcaaccacggccttgagcacctattttgaaacgccgatcagcgcagatgcgctgttaagcgatcgtctggatcaccactatgatgcggtcatgatgcccggaggcccaaaaggcacagacagcctgacggcaaacccacaagtgattgcatttttaagacgtcatattgctcaggataaatatatctgcgccttgtgttcatctggggccaaggtcttggcagctcatcatttgctggccgggcgaacttacagtactggtgataagctggctgataaatttgctgatggggtctatctggatcaggatgtggtggttgatggcaagtttattacagccaaagggctgggtgtcagctttgagtttgccttcaccgtggcccgccatttgctcagtgataacctgccaaaagttgagcaccaggccagccatatctattttaaacatgggtcagcacagacgtaattatcaccattagcccctgtacacgatgctctccccacgacggcattatcagtaccattttcgtttatatcgtcagtagcattgccgtttatatagccagcaccgcttatatagccagtaccgttgatgaaccgcatggtctgcggttcgtctcttcgactccccaacaccggtgttgaaatcaccgccgtcaggcccttgccctcccctgcgtaaaccgtccggtttatcgaatcaaccttataaatcatagatctgatccgtcggcttatttgctgcaggcatcgccctattctgattgacctgctttaccgaggagcgaaccaccagcttaccctgcaataataagttgctaaacggtgcatccgggcgtaatacccgccgctgtaacaattggatagcctctgcccccagttcatcacgaggaacatgcaccgcggtcagtggaacatcatggatttccgccaaattaaagccgtccatactcatgactgacaccctgttgggtacattcacgttgagtttattcagcgcgttaaccgcgccaacagccatatagtcgccaccgaccaaaattgccgtcggcagccggctttcatcctcacaggctgtgaaaaatgtggttatcgcctgctccgcctcttcagcgccaaacccatgagtggtgatcaggtgctgatgatcatcgaagcgcatattattactggcaaacgcgtctttaatgcccagcaaccgcaactccatggtattacgacgcaaacactgtagcgttagaatacggcgatgcccttgctgtatcaggtaatgggcagaaaactcgccaattgattggtggtcaggagaaacgctatccagtgacatttctttatcgcgacaattaattaataccgctggcttatggagactggcggccaaggcatggatccgtggatcatcaatgccaataataatcgccgcctcactctgtgggtgggtcattttatctaagaatagcgaaatatcactgtgggtttcggataacccgcagtaccggatcatcacttcatgttggctaaccgcctgagtgatcccctgtatgactttgtagtaaaaaatatctgttcgtacatcaaaagcgcgatggggagcaaacaccataatattattcaacatcaaccgcccgctggataaattctgcaagatcccctgcgatttcgcatacgccatgacctgctgtttcgctttagcgctggtattccctttacccgctaacactcttgataccgtgctaatcgaaagacccgtttgattagctatttcttgtatttttagctttccattcattttgtgatctccctcaaattagcaaatgaaaaaattttcattaccataaaatggctagttcagggcgctaagaaatataaatgatgaaatattagccgccttatgagaactctttcaaagaaaggcatattaaagccaattcaagctggttaccttagtttttataaaaatattggattttggtgaaccaatatttttaatttatcagtccagttaattttgattgaaatataaaaaactcaatattatcaattgagtatattttatatagctattttaatgtgaacaaagtcacattataacgcagcgtaatcttaataactgaagatggaacataccaaaataacaagttggtccaattcattttatatggactaacacaaggggactgggatgagtattgatattaatcaatcagctaaagttgtaggacggcggaaaataaagtcattacgttggtggatgctggccttatttttacttggggtcaccgttaactatataacccgtaattctctagggattttagcccctgagttaaaaaccagtctgaatatgactaccgagcaatactcatggattgtagcctctttccaactggcttataccgtgttccaaccactttgtggctggttgatcgatgtcatcggtttaaaaatggggttcctggtttgcgccagtgtctgggcggtggtgtgcatgatgcatgccggagcgggtacctggttccaactggcagtattacgcttctttatgggcagtgccgaagccgcagccacccccgcaaacgccaaagccatttcggattggttcccgaaaaaagaacggcccattgccgctggatgggctggggtggggttctctatcggtgcgatgttggcccccccgattatcgtactggcgcatgtggcactcggttggcaaggggcattcttgttctccggcgcattagccatgatttgggttctgctgtggtggcgtttttaccattcaccggatactcatccaaatctgagtcaagaagagtttgaactgattcaccaagataatgaacccgtattaccacgactgccattccttaaatccttagccattctaagtaaaaataagaaattttacggtattgctattcccgcgtttctggcggaaccggcctgggctgtatttagtttctgggtaccgctgtatttagccaccgaacgcggcatggacctgaaacagatcgccatgttcgcctggctgccattcctggcagcagatattggcagtgtcgccagtggctatttaaccaaactctatcagaaatggtttggttgcagccgggtcaactcggtggttgccagttcggtaaccggtgcttttatgatggtgtcattggcctttgttgccgtcaccaaagacccttatctggcaatcgctttaatctccattggcggctttgggcaccaagtgatctcctgcatgctcagtgcattagtggttgactcttttgataaaaatcaggttgctaccgtcaatggcctacgtggttcttccgcctggatcgccagcttcctgtttacattattaatcggggccgtttcagacactatcggctttaacccgctgtttatcgctatggggttcttcgatctgattggggccgtattcctgattgctctgttcgctgagcgccgtaataaaccccaaccgacggtctgatgttgttagaccaacggatgttgttagaccaactgatgtgattaaccaaactaatgttgttaactaaattgatgcgattaccccatcagatgcgattaacccagcagcggcactgcctgtgctgttgccagaaaaaggatgagctgtgatgaaaacattaaaaaactggctgttaatcaatgagtatcccgatcaccttgaactgcgggtcgatgaccgtcatatcttttgtctgtatgtattagaaccaaacttatgcagggtgctgattaaacgcgagggtgaactggcactgagccgcacctggagtattgccccgcaaggtgatgtgccatggtcaggccgcgatcgcctgagtctggaaggcttctctctccccggttatcaattggagaaacatgaacagcaactggtcgtcacgacggagtgccttcgggtcaccatccatcaaccactgcatctgacatgggaatataaaaacccgcatggtgagtggctaccgctggccgcagaccggccaaccagcgcctatctactcagccctcagggagaagcgattgctcactatcagcgccgttatcccaatgaacaatattacggattgggcgaaaaagccggtgacctgaaccgcgcaggtcgtcgctttgaaatgcgtaatctggatgcgatgggctataacgccgccagcacggacccgctctacaaacatattccgtttactatcacccgccgtgatgatgtcagttttggccttttttatgacaatctgagtagctgttggctggatttaggcaatgagatcgataactaccatctggcctatcgccgttatcaggccgaagcgggcgaccttgattactatctgttcctcggcccgaaagttttggatgtcaccaaagcgtttgtccgcctgaccggtaaaacccaatttggccctaaatggagcctgggttacagcggttcaaccatgcattacaccgatgcccctgatgctcaggtacaactgcaaaagttcattgcattgtgtcagcagcatgacatcccttgcgattcgttccagctctcttccggctacacctccatcaaaaacaagcgttatgtctttaactggaattacgacaaagtgccgcaaccgaaagtcatgagccagacgttcctacaagcaggtatcaaattagccgccaatataaaaccgtgtttattgcaagatcacccacagtatcaacaggctgcggagcgggggcttttcattcgcgacagcgaaactgatttacctgaacgctctacattttgggatgatgaaggctcccaccttgatttcaccaatccagacaccgtgatctggtggcaagagaacgtcactaaacagctcttggagatggggatcggttctacctggaatgataataacgaatatgaagtgtgggatggtgaagcccgctgtaatggcttcggtaaatctatcgccatcaaacatatcagaccggtaatgcctttactgatgatgcgagcctcaatggaagcgcagaaagcattcgcaccagaaatgcgcccatacctgatatcccgttcaggctgtgcagggatgcagcgctacgctcagacctggagtggtgataaccgtaccagttggcaaacactgcgctataacatccgaatggggctggggatgagcctgtcagggctgtataacctggggcatgatgtcggcggtttttctggagataaaccggaacctgagctgtttgtccgctgggtacaaaacggtgtgatgcatccacggtttaccattcattcatggaatgatgacaatacagtcaacgagccatggatgtatccagccgccacgccgatgatccgggatgcgatggcgttacgatatcgattattgccctatttttacacattgcaatggcaggccagccatgatgatgagccgatgttgcgccctacgttcctcgaccacgaacacgatagcctcacatttaaagagaacgatgactttatgctaggccgtgatctgttggttgccagtgtggtggacgctgggcaacggcaacggcagatttatttacctgataatcaggtcggctggtattgcttccacagcgggcaatggtatagcggtgggcagacaatcacattggatgcaccactagagcgattacctctgctggtacgcgcgggggcagccctgccgctatcccgacgtatcgcctttgttaatcctgaggctgattgtcagcgcgaattggcgctttatcccactcaaggtggcgggcaatcgagcgggatgctatttgaggacgatggtgaaagccaccgctggcaacaaggccatgcgctatggctaagttggcaggtcaccaccgataatcaccgtattgatatcacctttagccgcaccgggaactatcaaccggcatggcgtgaactgacgattaatttgccaacaaatgaaagtcgcacgttatcaatcaacggtgtcgcaggtaatacactggatttaaccaaactggcctaaccggctaatgttaaatacaagacggacttcctgatggaagcccgtttatttttgtacgggtaaaaacggcgagcgcagtaactttatggttcaacttgtttatggttcaacttatttatggttcaacttatgtctagttcaactggccaaacgctgagcaataaggcgcaactcttcggcaattttttgtaaatcacggtgctctttagcctgaggccccgtggaattacgcacgaccagtttggcaggcagtatcgatgaagagcgcatggactcgttatcactggcgctaagcatacgccgaaccgcctcttttccctgtaaatctaaatcaagtgacacggtagtgagggccgggtagaaaaacgaactttcataagtatcatcgtaaccaatgaccgacttctctcccggtaccgccagttggttttgatgaaacgcactcaataccccaagcgccatttgatcattggccaccagcacggcactgaactgcggtgtttcacgcaacatctgtaatgcgcctgaatacccactttgggcatcccagtttccatggatcacactgacaggcgataaaccataatcggccagcgtctctagccagcttttaagccgcaaatttgccgataccgactgcttaggccctgccagcaacgcaatctcacggtgccccaattcataaagatatttgacgctggcacgggtgccatctgccgggttaaacgaaacgttaaacacagaactataggggtcaacatcgagaaacaaacaagtgacatcatcattatctgcagcgattttctctgctacagccgtctctagagggacgttgataatgaccttgcctacccactgagattttaggtcattaatcgaatgttgaatgctttgattgacgctctcatcaatcatagaaatcagtacttgataaccttcaatatgcgcgtagcgttttattgctgcggcgacctgtgatggagcatgtaacgcgagtgacgtggtcaccagacccatcgtcatactttgcttaccaaccaattgttgggcaaggcggttgggtacataacgcagcagctcaattgactgctcaaccttgcgacgagtagcttcggatactttggccgatttattcagtacccgagaaaccgtttgataagaaacacctgcatggcgggcaacatcttctaatgtggtgcttttcgacttcatagtctggctccctctaagtgttattccttgattgtaacaggggcataggtgaaaaaccccatcacccgaatccacctataaatcacatcatcaaatgtattacgatcacaacaaaaaatccagtgagcgccatcactcatctttacaaaaaacactgatttatttgcagtaaatcacaataagcatacaaaataattgcttgattttacgtttaggcattttattgaatgcgttatgtgaacgtaatacaaaaattataaatgaggatgacatgaaaaccagtttacgcacactgtccgttgctttggctgcggcgttagtttcaccatctgtattagcgatagaaaaaattgatttccacggctatatgcgcgctggtgtaggcgtttccagcgatggtgggcttgccgaatggcaaaaaacgatggtgggccgtttgggtaacgaatccgatacctatggcgagataggtctgggggctgaggtctataaaaaagaagatgtcagtttctaccttgagagcatggtcagcatgctgtcagacggctctaatgatagcgaaacgaccattggtgacgatgctcaattcggcctgcgccaattaaacttacaaatcaaagggctgatccccggcgataaagaggcggtgatctggggtgggaaacgctattaccaacgccacgatttgcacattatagatactaaatactggaatatttcgggctccggcgcagggattgaaaactataccgtaggtccgggcgcagtgtctgtggcctgggtccgtggtgacgcaaacgatgtggatacccgcattactggcgatagcgatgtcaatatcaactatatcgacgtgcgctatgcaggctttaagccatgggctggctcgtggaccgaagtgggtatcgactatgcaatgccaaacccaaccaaacaacagaaagaatacggtgggttgtacgatgctgataacgcggtgatgttaaccggtgaaatcagtcaggacatgtttggtggctataataagctggtgctgcaatacgcaaataaaggcttagcacagaacatgatctcccaaggcggcggttggtatgacatgtggcataagactgacgaggctaagggatatcgggtgatcaacaccggtcttattcctattaccgataaattctctttcaaccatgtgctgacgtggggctcggctaacgatattactgaatacactgataaaaccaatttgatttctctggtaggacgtgcgcaataccaatttacacaatatgtacgtgctattggtgaagtggggggtttctatcaaaaagatacttatcacaatgggtctaactacaaacagggtggtgagaaatacactatcgcattaggtttggccgagggtcctgattttctgtctcgcccagaattgcgtgttttcgcttcttacttaaatgattcagagaatggcaagcctttcgaagatgggacatctaatgacacgtggaactttggtgtccaagtggaagcctggtggtaatcgttaagattacgtagacataaatttatctctatcaatatatacccgtaatatttcaagctgtatatgcgttggcggctttcgttcactcccgttgccgccttcctacaacgtggtttatttagggtatagcatgaatgaaatatcacgactttaatatgattcggttattcttctatgctcactacccttaggtagtgagcattttagttttatacccgttatacctcaagctgcatgtacgttggcgacgctcaacaactcgaattattttggggtatacattattatttacaaaccatattattttcaaaccacattttttaaagccaaattactttaaaacaaaatcactttaaaaccaaattgctttaaagccaaattgtgagttaaaaataaattctttaggattgagagaaatgctcatcaagtattttacgcaggttatctgactgcttgccaaatatagcatgtacctcctgtccaagaataataacgcctaatgcccccgcttgttgtagcgcttcagaattaaccttggagagatcgtttaccgtcacccgtaaacgcgtgatacaggcatcaatattcttgatgttctcttttccccctaaatagtgaagtagcatttcagcttgttgtttttcttcatcagtgaatgatggcgttggttttggatgggaaaaatagtgcataaaagatttcaggctgatcatgacatctacctttctgttggtgggttgagtgaaattgagttaattcgttgtaagtcgatgtaaaaaaacgcccactcggctgaatgggcgtgtatggcattcagttaatgcttattcgagatagcgagttagcactcggcttccccatggggcaagcgtcaggctaccttgtaccggctgctggtcgaccatatcgcggtataccgcaggtaacaccagcgatttgctgtcattactgtagttttctaccacgataaattcactctcaccatcggtacgacggtgagcggtaaccccataagggaactgggtgtctagcgcacgtgccaagtttagctcctcggcaatgttcatgaagaaatcacgctggaaagccgcatcgttacgtgaagcgacataccaggctttaccttcgccaacaaagtttacggtcaccgccgcacggtcagcatagaagtcatctctatagcgcgcgacggctgtcgccccttcaagatgaatcaaatcgcagagatggatggcctgataaggcccctgtagaccggctttattgcctgcaagtccttggacttgattgctctcgccatcggccagacagtcaatttcttcggaccagatacccaacagcggccgcagagggccagggaagccaccgagatgacacaggtcagattcgttgacaataccgctccagtaagtcgcgacaaactgcccaccttgctctacaaaacgcgtcgccctttcagcaaacccttcgcgaaccatatagagcatcggtgcaatgaccagcttgtaacccgacagatcgcagtcagcgttaatgatatcgaccgcaatgccccgttcccagaatggacggtaatgctcggcaacggttttctcatattccaagccacaattacgtgggccttcggcgtcgtccatagcccaacgactttcccaatcaaaaatgatggcaacatcagcgtctactttacttcccatcaccggcgacatggcctcgagtatacgacccagttcgctcacctcccgcccaacacgggtatcaatgtggccaacatggtcgacaaccgcaccgtggaatttctcaacggagccacggctcttacgccattggaaatactgcaccgcatccgcaccgtgcgcgacagcctgtaaagaagagaggatatgcatccccggtttcttcaacttactggtaggttgccagttggtcgcgctcggcgttgattccattaagacaaatggacggccctgtttcagggtacgcatgaggtcatgatacatcgcggtataacaggcaagctgcgtttcatctttctcacgatgccacatcgggtagctgtcccaggagataaaatcaatcacctgcgccaacttccagtagtcgtaatcgtagaagtactccataaagttagtcgtaacaggcaactctgggtttgccgcctttagtggcttcgcttcttcagaacaaaactccgtaacctgagcggtattaaaacgccgccagtcaaggttcagaccatgaattgaaacttcaccttgcggtgctggagactcaatttgcgaccaatcgctgtaggtgtggctccagaaagcactccaccaggcttcgttaaggttatccagcgtttgataacgatcctgaagccagaggcggaatttttgctgacaggaatgacagtgacattcgccgccgtattcattagagatgtgccagccaataaccgcaggatgatgggcgtaacgctctgctaacttctggtttatctgccgcactttctggcgatataccggcgaggtcatacagtggttatgacgcccaccatgcagcgcaggcacccgatcacgcccgacacgtaaaacttcaggatatttctgcgacatccaagccggacgtgcgccacttggcgtcgccaggaatatatggataccggcagcataaagtttttcaattaattcatctaaccaagagaaattatattctccttcacttggctcaagttttacccaactgaatattcccactgacatgacattgcattttgcctgtttcatcatggcaatatctttatcaataatgtcaggataattttcccattgctctgggttatagtcagcgccatgcaataacgcagaaactttcgcgcttaagggcggaaacttagacataatacatccttaaataataaatacttggtgttgcccataatgggcaacgattaattaaaaactttcatcgaaggcaatacttttccttggcaatcaaataacgcctgattttcacgtgcattaccttctttccaattatcattgatatatttcattccagccggtgttgcccaagtatttcccggaacagaaatccaggtaggctcccagtaaaatatccccttccctctgccatcggggacattaataacactctgcatcagatcatgaatgaaattcgcttgtccttgaaccgttccgggataacccccatctttctcttctttagcggtaaagctattttcggcgttatcacaattttccaaggtatagccataagcggcttccacgacgatgacatctttttggtaacgctggctgatatcatccatgttggtttgcaaggcgctaatcgggccgtcccagtaggtgtacatcgacagaccaataatatcgaacggcacattacgtttggttatttcatcaaaccaccaatggaaggtgtcattcttggtgccttcagcgaggtgcagcatgattttcacatcagaaggggaactgaggttctcacgtaaaccgccgatggccgcattcagcaaacccgccagccgatcaaactcaccaccgccttccccccagctttttccttctggccagagaagaccgccattggattcattgccgatttgcaccatatcaggcaagacaccctcttttttgaaggtggcaatggtatcgcgggtatagtcatgaatggcgactttaagctggtcgtaattcattttctgccaagccttcggcttaaattgcttacctggatcggtccagaaatcgctgtaatggaaatcaagcaatacctttaaaccctgggctttcgcacgtttagccagcgccaaagtggtcgccaaatcgttactgccaccgccgtaactctgcccatcgctgtctttgggatcgacccacaaacgcagacgcacataattcacgccgttagccttcaggatagccattgcatcttgttgaacattttgttcattaaaaaatttgccaccttgtcgttccacttccgctaacgtggaaatatcagcccctttaataaaatctgctgggacattttttaatggcgcaatggtaaagggttctgccgcattagccccaaccatgaggcttagcgataaacaaacagtcagtaatgccggtttaaagaatttcattatattatcccttagtacttcctgacgttaggccggaaacaaaatatttctgtagggccaggtagagaatagcaacggggactgcaattaatacggctcccgcagcgtaagtggtatagctagcgcccattttttgcgccacgaggttatataaaccaatcggtaacgtatatttatctggagtacgtaaaatcgtgctcgacaaaataaaatcacccaatgggccggtgaaagaaaataatgccaccacggccacaataggtttagaaagcggcatgataatttcaataaagatacggaaattactggccccatccatacgtgccgactcatcaagatcttttgggatcgcgtcgagataccctttcattaaataggtattcattgggatcatgcccgcgacataaatcagtaccagagccatatggctgttaattaagcccaacaattgcgaaagcacaaaaatggcaatcagtgcagaaaattgcgggatcatttgcagcaacagaaaaagcattaacccattctgacgccctttaaaacgaaaacgggagaatgcataggcggtgaaactgacactgatcagcgttaagaccatggtcaaaaaactaattttcatcgagttccagtaccaggtcatataattcacctcgccgttaaacagatcggcgtagtgctggaaggacagattctcaggaattatcgacgtactgagcaggctattaccggcgttcagtgatgcacccaccgtccaaatcagtgggtaaataataatgaccgataccagaataataaccagccaagagagcgataaacggatccatttctcttgtttaatactttgtgacttagccatgttcccgtcccttatgccatatcatcatttttaaatgattttgttgcgcggaattgccacaacgccaggccaaccacaaagatggaaagcaaaatagtaatggttgctgctattgcgtattgcgaagaagacatggtcaatttatagatccacgacaccagaatatcggtgcctcctgcatttgaccccgccactgccggcccaccgttattaaacaaataaataatattgaaattattaaagttaaaggtgtactgagtgatgataatcggcgcaatagaataaaggaccaacggcagcgtgatggtgcgcaatttggtgctggtactcgcgccatccatggtggcagcctcgtataaatcgtcgggaatagcctgcaataccccggtggtcatggcaaaaacaaacgggaaacccagccatgtctgcatcataatgagcgccgttttagtccagaacggatccgtcatccacgctttaggcgcaatgccaaagaaagcgagaatggagttattaatcaccccaaacgagtcgttaaacatccctgcaaataccaagatggtgacaaaacccggtactgcccatggcaaaataaagatagtgcggatcaaaggtttaaagcgcagatctttttggttgaccaaaatagccaacaatacacctacggtacattgcaacgtcgttgccagcagcgtccataccacggtccattgcagcacgtcgaagaaggttgaacgccagatactcagggtgaaaatattaacaaagtttttaaaccctacccagtcaaccaatttagcgggaggtgtgtgataaaggttgtagttggtaaaggcaattgagaagccaaataggatcgggaaaataaccgcgaacaccagcagaataaatccgggggtgatcattaaatacgggaagccttcgcttaacaggagttggtattgtttgcgcacactattaagcggaatacctgcatcacgttttttcccattaacccaagcatcgcgtaatgaaaaataataaagtgccacgccaaagccaataatcagcacactgattatcccctcagccagcaggaaaattgagttgtcacgcggaacttcttctccgagggtatacaaaccccagagcccctcttgcagaaaatcaaaaaatacgccgacaaaactgcttatcagaactaaaaatacgagtccctttgcccattggcgatgataaaactgaccaaacccaggtactaccgcacacagcaccgcggcaatggcatggcgactagactgttttgctgccgctccgttatcgccagaactgataatcacacactgctccttctttcatcaccctttaggttattcaccaggtgttgattgccgcagtcagtttgaaacacaggtggtgcacaaaaaccatcgcataccaacggcacgtgggggaattgaacaccacctaaattcatactgacctgttaaatagtctgattactgattactggcctgcatggcctcgatttgcatattgatctgcttaacggcgttatcgagagcgactttaggctcctgtttgcccgttacgcttagctccaatgctgagttcgcaggtccccacacttcgcccatttcaggaataccaggcatcgcagaggctcggcttgcctgaatggctaccgcactggctttttcatcatttttaatcaatggatcgtcaatcatagccgtcaacgcgggaatctctttggtgacctgatagcgggttttcacgtattgcggctggttaataaattcgatgaactgctgggcgagtgccttatctttgctccaggtagaaacgacataccctttcacaccgaggaaggagctcatatctttgccgttcggcaatgctggcagtggtgacacaccaaagttaataccagcggcttcatacggttggaatgcccatggcccgttaattaccgccgccgcttttttctcagtgaataatgagtcaatagcattcaagccgttatcaccgatggtgccgattggaaacagaccgttagcatagaatgttttcaaataggttacggcctcaacagcccctggcgtatttagcccgatatcgttagccttcaagctaccgttagcatctttaccaaagatgtaaccgcccattggctcaatcgctccccagctgtaatagatctgatcgaacttcgccaacagaccatatttattttctgcgcgttgtttcttagagaatgcggcgtactcatccaaggtagctaacggcgttggcagcatgtctttgttgtagatcatcaccagcgtttccacggctttcggtaaaccgtagagggcattatccatggtgaaggcagcgatagaaggtttagtaaaagtagtgactatggttggatcaacgctgagcggtgtcagcaaaccttgcactaccgcaccacctaactgatcattgggaatcaccaacacatcagggccgatacctgcagggccatcaaggcggagtttttcaatttgttgtgcgtaaggcatttccagcacattgaccttaacctgatgctgtttttcaaaatcagcgatagcctctttaataccggcagattttttgatgtcttcccaaactgttaattgctgtgtagcagcgtgggcagcgaaaccagcaaactgggtgactgccagtgcggttaaaacaagcgcagtgattttattgattttcattattagcctcgggtgaaggtataacattattgtgtttaacgctcgggattaaatacaaatacaaaatgacaaacaccacatctacgccatctgcagaacataccatgccgatgtcttactatgttatacgctacgctttgacgcccattaactctataggaatctcatcattgtgtgatcatggttgcagaaatgaaagtgtatgatagggacggaaatagagcgaagttatagttcttccatgcttttccatcatcacataccattaaagccaattgttatacgttatacataaaatcaaaaaacgcaccacagggtgatgtgtgatggccccctgactgataactttcgaggattaccggatgtccagcattagactgagaaacgtgaccaaacgttttggcaaaaccgaaacactccataacatcaaccttgatattgaagatggggaatttgctgtcttcgttggcccttccggctgcgggaaatcaacactactaaggatgattgccgggcttgaagagataagtgatggtgaggttttgattgacgatgaggtgatcaatgatgtcgctccctcacatcgtggcgtggcgatggtcttccagtcctacgcgctctacccacacatgacggtagccgaaaacatgggctatggtttgaaagtcaataaggtgcctaaagagcagatccgtcatcaaatagagatggtggctaaaaccttacaactgtcccatttactcgacagaaaaccaaaacaactctccggtgggcagcgtcagcgcgtcgccattggccgtgccattgtgcgcaacccgaaagtgttcatgtttgatgaaccgctttccaaccttgacgccgaactccgtgtcgaaatgcgtctgcacatcgcaaaacttcatcaggaaatgaagaccaccatggtgtatgtcacccatgaccaagtggaagcgatgacattagccgataagattgtggtgatgaactacggcaagattgagcaaatgggctcaccaatgtcgctctattacaacccggtgaataaatttgttgctggttttatcggttcgccaaagatgaattttctgcccgcgaccgtggaaagctggcagcctgattccgtgaccgtgaccgtcgccgaaggccatagcctgacattggcattgcacacctcaccactacaggccggtgatcccgtcactattgggatacgtccagaacatctcagcgtggctgatagcacagtgcaaacattagattttcattgcgaagtggtagaacgactggggaataacacctatctgtttggtcagtgccacggtcacgatggcttcaaaatgctgttagcaggagatgtccatttccgcccttatcagaagctaaatctgagttttgatgctggatattgcatggtgtttaacgctgatgggttgcgcataaatgcagagattccggtgcctcatgaataaattgggctaatataacggcgtcaatatattgaaaaacggttaagaataccaagcgggtttcctgttgaagcccgctgaatattaagatagcaacatgtctatttcaccttgatgtctatttcaccttggctaacatcagtatttcgacgctaatctaagcatctgcattcacttttccggtccgtctcgcccccttcaatcctcttctgaccatgatgtcagttcctcagccacatccgtgacactcaatgtcactcaatgtcactttgccgttgtgacattctacttatcactgccgctcgatctatgcagcaaaatgaacatatgaaccagtaaaaatctaaagacatatttttaaagacaacatcatcagatcagataatcgctcccttacaaaaaacgttgcgtaaatctcgcttatcttggctttttactgcatttgtttgagcgatgtaacgtaattgttgccggagtgtggacgttttttattccacacagtagtgttcatttgtttttggttcgttcatatgaggcattcatgatccgtaacgagatactggcaaaaaaaccggactatctattagaagcgacgggactaaaaaaatcctttggcgatgtgatcgcgctaaacaatgctgaattctgtttaaaacggggttctatccatgcgctttgcggtgggaacggtgccggtaaatcaacatttcttggcctattaatgggatttattcagcctgatgatggagcgtttttcatcaacgggcaatactgcgaattcgactcaccgggacaagccctagccgcagggattaccattgttcaacaagagctcagtggggtacaggatctgtctgtggccgaaaatatttatctgggttctgagccaaggcgctttggtattgtcgattttcgtgcgcttaaccgccaggccgatgtgttattacacgagctgggtttcgccatttcacccaaagccaaaatgcgcagcctgagcgtagcagagcaacaacgggtggaaattgccaaagcgctgtcacatacccatgccgatatcatcattatggatgaacccacctccgcattaggtgaagaggatgcgcaaaaactgtttcagaccataaaaaaactggcctctctgggaaaaggggttatttatgtctcccaccgcttgtcagaaatatttcaaattgcagacagctacacggtatttcgagatggttgttatatttgtgaaggagagatgagtcacatcactcgcgaacaactgattgagcatattattggtggcgagattgatggtgagttctccaaatacaatactccaaccaatgtgccactctttaaagcctctggcatatgttggaaatcgaaagtgaatgatgtcagcctgacattacattgcggtgaaattttagggatttatggcttagtgggatcggggcgcagtgagtttcttaatctgctgtttggtcttgagcgtgctgatcacgggagcatccatatcggtgatgagatattactgaaacacacaccagaaaaagcaatcaacgccggtatcgcctatgtgaccgaagatcgtcaagagacaggattagtattgaaccattcggtatcggaaaatattaatatctcctcattaaacgtcattagtcgtatgagtatcattaatgaaaatgatattcagcgccgtgctgaccacacgatccgtatctttaatattaagacaccgagtcgccaacaacgagtggctaatttaagcggtggtaatcaacaaaaggtggtgttaggccgctgggcactgttagaccctaaagttttattattagatgagccaaccaagggaattgacattggggcaaaaaaagaaatttatcgctttatgtcggattttgccctcaaaggaaaaggcattgttatggtctcctccgagctttctgaaattattggcatgagcgacagaatcttggtttttaaaaaagggaaaatagtcggagaaattatgggctcggaggcaacacaggccaaattaatgtcgatggcggtataaatcacgccgaaattcatattattacattgcagcactgagagcgtcgaatatgagcgattccccccccttggtaatgtctctgacacggaccagtaaattcaggaaggccattcatcaatacgggatcatacttgcctttgttggcttgtgtgcggtcattgctctggctggtgaatttgcagtaaacagcgggacatggagcgagaattattttttatcacgggataatacactcattattctacgccaggtctcgatcaacggcatcctggccattgggatgacgttcgttattatcaccgcgggtgttgatctctccgttggcgcggttttaggcttggccggtattgtcgccgcgcgttttgcgacgaataacagtgccatcgccttgggggggaccgattggccactgttagtacccatcgtgattgccattggcatcggtttagtctgcggcgctatcaatggctttatcttaggcaaatatcgtctgcaaccctttattgtcacaatggggatgttatctgtcgcccgtggcctgacattactgactactggcggaaacccggtatcacaattaaccgatgaattccgttggttaggtaacggttatattttgggtattcccgtaccggtgttgatctttattattctgttcgccattgcctggtttgtcttgaataagatgacgtttggccgttacgtctacgcggtgggcgggaatgaaaaaagtgcccgcacatccgggatcaacgtattacgtattaaagtggcggtatataccctttgcggtattttggcggcgatcgcgggtttaattttaaccgcacgtactggctcggcacaaactggcgctggcgtatcctatgaattggatgctatcgcggcggtcgttattggcggcaccagtatggctggcggtattggaactctgcgcggaaccttatttggtgtgctgataataggtgtgatgaacaatgggcttgatttactcggcgtacaatcctattaccagcaaattatcaaaggtgttctgattgtctttgctgtcatgcttgacccatcccgtaagcaataaccttcataaacaataatttttataaacaacaagttttataaaaaaatatctaccaataacaatgtctacaaataacaatatccataaaaaaatgtccataaaaaaatgtccataaaaacaatacccataaacaacaatattattaatctatacccaaattaattcgagttgtaggagggcggcaagagagatacaaatgggtcgggaaccgatttgtacagtatttatgctgcccgtagggtgagcctcagggatgaggcgcattaatcccgatgagcttacttacttttttaaagtcaataccagtaagtcattcgggtcattgagcgtagccaacacacatgccgtttgatgtatgacgggtatataccgtaactctataattttaaagtaagttgaacgcaccaggagcttttatgaaaaaaacaatgctacaaactctgcttgctgcaacgctgatactttcctttgcggcatcagtgcaagcagccccagtaaaaattgctattttgatgtatggcatgaaagctgaatttgttcagctaatggaaaagtcagccaaagaacatcctgcggtaacacaggggttaactacgttgactcttttcgatggccgctatgatccgttagtccagaataaccaagccgaaactgcaatacgtacccgttatgatgccattattattgttccgatagattttgaagccaacgtagatgtggtcacgatggcgaataaagccaatattccggtgattgtcgccaatgcccgcttgaatacagataaagcgaccagtggaatcttctctgatgatgttcaagggggttatctggaagccaaagcggtgctggataaaatgcagtgccagggcaatgtggtcgttattgaagggccaatcgggcaatccgcacagatccagcgtggccagggcaacgataaagcgattgctgaatgtgggccggggaaaatcaacgtactggaacgtaaaaccgccaactggtcacgtgccgaagcgatgccgttgatggagaactggctacaaaaacatcgtggcaagattaatggtgtgatcgggcaaaatgacgaaatggcgttgggtgccattgaagcgatcaagagcgccggcctgaatgtccaagattttgccattgccggtatcgatggtgtctctgatgcgatccgggcggttaaacaaggtgaaatgatgtctatcctgcaagatggccaggctcaaatacaaggggctattgatatcgctatgcgttcggtacaaggagagcgttaccagccgatgtcaacgatctggcagcaatatcagggaaaaatggattggcaacaagggacggcaaaaatgtatgaagtgccttggactgaagtaacgccacaaaatgcggacgagctgctaaagatgcgtcagtaagagagatgatcgctatcgcccccggcagcggcaaaatctgctgtcgggtttgagggtaaatccccctaaaaaccggagtattcattgaatctgcgctcgaactgcctctatgggcacctgactcccctacctattctcattgttcaagttcgagtcgttaagagatatcatcaacctcagtaacgtttatttttggttccatcaaaaatatcctctaaataattcgtttgccgtcttcctgtagctcgaattatttaaggtctatcttcctacaaaatacaaacattttattgtcatttcactcccattccattcgcaatattttcgacactcacggagtagcttcatattttctaaaatcataatttatactttattgatcaacgcacaagaatcatcttagtaggaccagaagaaatagttaatatttatttatcaattaatcacctttcatggaagcattcaaaaaagattaatcctaaaaacagagaggcatttacctttttatcgtaggaaataacccataatatgcatgaaaaatcctacagttcatcatgatgtaaatatttttcaattaacactgaaccccttaatttaatatttggttacaaattaaggtttggcataattgagtaaacattcttattatcagcctcgtctttaggaaacattaacatcgttcgtttacctacgtaccgggcattttggacttgatgcatccgttagataaagtctgcacagaaaaattgggccataatggtcgggaaagtaatgacgaatgaaaaataaaatattcacagcaatagtgctattattttcctttagcctttcaattcaagccattgccaataaaaaaaacgataaaaaaatcatcattaataacctaacactatcctcaacatgggtgcgaacggccatatcagagtctatagacagcccgagcaatacgataaataaagacgatatcaagaggatggcagcaggaaagcacatatacataatggataataaaataacgatagagggagtctgtacctttaagtatgttattaaaaaaagcagtcctttaaattattggcatagtgataaaaccgttaatttatataaagaagagtttctaaaaaacggttttaagttaagcgaaaatttagcttttatttcagctgaagatccgagtaatgattgcgactccccttactctcaaatcgccataactgataatgtgatatttactgtttataatggtcatattgtattttacacaaattcaaacaatgttaatgaattggcattatgaacagtatttgaaatattctcgattgcttctataccccaaataactcaagttacagaaaggcagcaagcgagagacaaatcggttaggcgcagatttaaacgctccatgcaacgtgaagtatgacgggtatatataccaacattagaccaccttcctaacatgctctgattaaaaattttcccgtacaacaacagtcaatgaatcttcggctgaacccgttactgaatagtggctctttgtcgttaagcaagcggtcattgttaactgatcgctaaatgttaagcaaaccacaaatttgattgcctggcttccccctattatttatacgggataatcttaagagcaatggaatacactaagaaataaggaattgtaatgcgaagtatcgggtggcgttttttcactctagggtggctgattttattagccggttgtgcgactgatgtttcgttatcaggaaaaaataagagcacagaagctaaccgaattcagtttcaacggatgggctctgcgccagagtccggtgcggcagacgtcaccagcctggatctccagcccggcgatattttgttgtcatcatcaactggcattaactcgttgggtatccgtatattcagccttgccccagtcagccatgcggctatttatctgggagaagagcaagtggccgaggcaaccagtacgggggtgaatattgttagccttaacgaggcgatagatcataacacggcggttattgccttccgttaccccggattaaccccggaacatgccgctaaattgcgtgagtttgcattagataaagagggctcggattacaacttcggagggatcgtattgatcgccccgtatatgatcaccaaacgaatatgcgaattgccgttatttaatgcgaccgttcgtaaccactgccttagcctgctagccacagtgcaattaggtgacggtgggtcactgacggaagatcagcgcttcttctgttctcagtttgtcttggaagcctacaattatgcagggcacccaatcagcgactccaatccggtatggataacaccggctgatttactgcatatgcgcgaaggcgacagctcttcattccgctcaaatcaacccctatcgtatattggccatttaaaacagcgcagtagcttatttacaggcaacaaaggattggcgatgaacaatgcagacacattacttgaggacaaaagcccccgtatgctgagccaataaccgtttggtgctgctcacctttttatcagaagggagcaagcccaaagcgatatatgtccggctggggtgtttggctcccgtctcccacttctgaatagtagaaacacgggtatccaaatagcgggcaaaaataggctgactgatattgtcactcagccccccttgaccaaaatagccaattcccagttcaacattttgatttaaaaatcattttttgatatccccaaggggaaaatctggcattaaaactgcacatcttgattccggtactgaaaccacttgatagcacatctcactggctgccactaaaagcacgcgggatgcgttgcgcagtaacgcgttttagatatatcttttttttatttctttcttgccaatttagatatatcggtatagtttagatatatcgaagttgtttcgatatatctaaaggagatttacaatgtttggtcattcaaaacacgatcatcgtcatggtggtcatcgccatgaaggacagggccactgcggtgaaaaaatgcgtcgcggtggtcgccataatgtgatggcagaagatgcagaatcggcaagaggcggcaaacatgggcgcgggcgtggcggtaaaatgcatcgcctgttcgaacatggggatttacgcgtggtactgctggcgctactgaataaaacccccagccacggctatgagctgattaaggctattgaagaagcgtcatcaggtctatatgtgccaagccctggggttatctatccaacactgacactgttggaagagcaggattttgtcacccccgtagccacgggtaatggccgcaaaagttaccaaattactgacgctgggaagtttgaactacagaaaaaccaagctatggtcgatgtaatctttgctcgtctggcgcaggtaaaccgtcacaaagaggggaatctggctgaaggtattgccgatgcaatgcaccgcttacgccacattctacgtagcaatatgatgcgtgcggatctcacgccagaacaagtagcgcgtattaatacggcgctactggctgcggtagacaccattgaagaagagttgcaaccggttggggtgcaacctgcggcagttgatgccactgtacaggagaaaaactgatgcccggctatcgttatcgaatcactattgaacccttgactgaccgtaagggcgcagccattgataaagcccctgtcacctttgaagccgagaatcatgacgagatcctcagcatcatcgaacggttacaggcccgtgaagatctgggcttcggccaggagaaaactgccgcctttgccttaggtttgaagctgttctcggaaaccatgatggagaatcgtaagcatccgctatttgagccgctgcgcggtgcatttaaagactttatgatcctactgaagaaaggttcaccgcgtgaccgtagtgatcatgcagaatagtgatcatgcagaatagccgctcttgataagagatcggctaagtttggggttaagctcgtcgctgagccgtcaagaaaaccactggttagccgccatcatcaccgcatagcgatcaccgttgctcccttctgagagctgatcaaggtgcagccacaaccacagcgatggccatggaaagccactggaatgccgttatccttaaatgaaggatgtgcttctataatgaaggtattaccatgctgtgggcaagagaccggatcattcaggcgcgccacaccaatacctgcaaatttcattttgccagacccactgagcacttgcccgccatgcgtggttttatcaccaatacagatgacgcctttcatatacacctcaatttttctattaatttcacttattgacattgcgctttatgttcaattaactgacagataagcaatgtactattccctttctatagcgaacttagcactgctgcagttagtattttatttattgtgtcatcaagtggggtttctttaaaaaccttcgtatctaagacgggtaagagcaatgccgtatcgccataatttgatgcaaaattgacatcgctcttgaccgaataataacgtttcaatctcttacaagaaaatatgctgtttttcaccgttatttttttcaattttggcaagtattttttcaagagcactagaatctttatcattttccattatatttttctggaaagttatttttttctctaatccctctaaatttaatttaatcttgaatttaccttttttgctttctaccaggtcaacgtgctcaattgagataatataagtattcgacatcaacgcgggtgtaaataccagattatcccccattaaggcaatcacagggcgaggccccaaccgaataccatttatcatattcaacacaccgacgacaataattaacatactcattggcatatcagtgaaaaacataaaaacacccgctacagttgcaaacgcacctagcataaaataacgaacagtggcaaaatttagatatgtatcaagcttacccgtttcatttaatgaaaacgtctttaaaccacggtaaacgtaatcgttataggtaaagagataaccaataaggaaaacaatactgaggggtaacatacccaggcaagagataatggccaatccaaatgaaagtttattggctttatctagaaaaatcacgctaaggatttgcaatacaagactaacagcaaagtagtatctcaatacggcgatagcatcaagcaacatccgatctctatagcctaactcaccatagagttcctgatagtctacagtgaaaaaccaactggccaaaacaagcactaagtttagtgataaacctatccagaccagtaaatttacctttttcataaattacccttataattcataaacataatattattttatttattgtacatatttacaccatttatccagcacatcttattttaatatgtgttaattgtaatatgtattaattgtaatatcccatcacgtgaaccgtcaccgcctatagtcaagctgtaatagcctattttagatacatgcccaacaggtgataaaacaatttaatggtatatcgcaatatggctattgtataagatgacgtaagctatcatagagcaaccaagcaatggaaataaaaagttgcaagttagcatgataaaaatcaataaagcatcaaagccgcaacttcaaatgagaatattcacacaacaatgtaggaatattcaaccaaatcatgattaaattataaaaagttaatcacaaaaaatcagtttatttttattggatttaaatggtcgcatcaaaaaaataaaatagagtgagtatcttgtcggtttatatttaaaatctattcttagttcctatttttaactctctcaactatttccctttgggcaacaaggtttggcaacttggcacttatagaaacgcacggccacattggtgacgacggaaatgttcaaaattatttaccgttagcaggttcagagcgaagatgattaagcaaaaagacgacttctccccgataaaaaggggaagcagccagatactgttcccattgcggatcccactccccgtgttgaaccaaaccaatcttgaagggaagacgtaattgcagcaaggcgggtaagtaacgtgagtactgattaacggttgatcgcccctgataggtttgtatcaccagttcatcaatcggcaacgcattgagctgctggatgctaccggtttttgcccagtccaataagccggttacaccaagtgcaaaatttggatccagcttagtgcgcacccggcgcaggaacccagcgtaatcatcaagacgataggtgcctgcatcaaaatcaatctgtagcccgatgacctgatttccagcggcggcccaccgccggggtaaatcaatcagaatcgccaaaatatcatctggtacatccaacgtggtgatgcgcaccgtgacccacatcgcaggcagtgtcagcctagagctgggtagccccattttctgaaaccaggcagctcgttggcgaataaccacttccccctgatgcagataaacctgattcgcctgctgtaaagcgggctgtgggttcacacctgaccacaaccaaaacgcctgataatcatgggcatacaccttatggctcaactgcagtttgtcgctaacctctgccatcgcgggcggcataaatagcgctaataggcagcttaccagtaatagttgagccgttctgcccatcggctacctttatactgagttttcaatgagctaaaccaacgcttacgtgttgcaatatcgacatcctcacccccacattgattatagcccgatggggcatagcacataacagcccggtaaagcgcatagcttttatcttctggctccgccttcgggtcgttgataacgtgttgataataatcgaaacgattgggctgagttatcactgtttcatgtgcatggactgcgacattcagcacctcattgccctccccttcctgataagtattgatattgatgtcagttacacggaagaattctcccaagcagttgagggcatgaccatccgttttatttttaaccaatgcttttaccgtcccatctaacgcagcacaggcatagccctgctccacattatcgccctgccaatcgaacgccgccaggtctacatcggcaaagcttttttgatcgacggattgctgaatatgagggcttaactgtttatcctgctcataaccctgataatcaccaagcataagatcccgcagtaatagcgtgtgcagagcaatggttttttcctcatcattagcaccagaaataacttgctgttgtaaaagtgctttttgagcttttgttttgagtatcagagaacgataacgcaggtttttgattgggctatctgcggtaaatatggcctcaatttgatcactgttcaccagaaccgcggcgagtttgagttgcagatattgctgttgttgcggcgattgcaccaggcccagcagcttgcgccaatgtgcttcggcctgtgaccattgttgttgagccaccaatgcatcaccatatagaatctgttgactgaaggtcacaatgtcagtggctggcagagagtcgacagccgagacagtggcgacgacaccggcataatcttgctcatgataatagagccaggccgtctgtagatactgccaaagggggagcctatccgcatcgacaaacatcggtttataacttgccagtttctcctgcgtaacctccaactcagagccactctggcgcccccctaatcgcaaccaacgtaatgtttgtgtgaaggtcagtaaaggtgcttgcatatcgctgataaagggctcgccaccaaaggcatctttgctgataaatttagcatcaacttctgatacggtatcccacaaagcttcagcattcggtgctgccagtaatgtctcttcatacagccgcgccagttgttgccaatcagagaggtaccagtaaatacggcgctccaacccctgaatcgactctgcgtaaatgccttggggataagcaactaaataggcccgagaataatccaatgcctgacgggcggcatcctgattgatatttttagtttcaaacatgccatatttatccgacgcatttgtactgctctcattgagcgcaactcggaacaacatataagtcgctgtttctgcgacccatgcttgagaactcttttggagggcagaaaataaagcggtggcctctgggtaatcgccccgataaaatgcattggcaccatgaagataatcgctaaaagcatcaacatgtgagcctggcacaatgttaaaaggtggcggtgtaattccaccatcgaccggtgcatcgacattatgaaaaatattggatcgccagagggctaaattatgtcgatcgtcggcagttaaggacgagtctgccagtaaagcggtaaaaaattgctcaactgatgcgggattattggagatatgccgtacttctctatatcgggcattggttcccttaaacgaagccgaattgatgcctagcgtctttgccatcttatcaaatggcgtttcttccgaagggctatcattattctcatctgtaagacttttttcccgcttcggaaaactcatttcatcataataaaactcaccaaaatggtaattcctactacgggtaatatccgctggcatcgttaaacgtggcaatatgaaattttttggttctccaaccaataacatcatattaacccgagtatcattgtaaacatccaaaaagggtacaccactgagcgggcaatattttccccacacacagccagtattatcagaagaagcctgtgatggaggtgccgccatacctagcatgcccattaggaggcccatccataacttactgtttattttcattctcgcttggcacccttcaggaaatccgacattgtcgcttatattttcagcaaaaagaacaagaaagcactgaaatccaagatgaatatcggatactgctgccacgaataaaaacataccgttaatcaagagctgaaagcgatgatgttagatatgtatattcatctggccaaatttagtgtaccgattaatctctggtttgattggcaccctctagcagcgcggtaacgaatctgcgctaatggtgtcagagcatcgaaaagcgccttttattcttcggtgagcgtcatttcgatgccttaggcttgaccggtatagaattttctcattaataatgatagcgagggcctttctgaacaaaatagtcagtgggctatttatttagagcgtcctgatttagtttattgatgagctgtagaacttgttcatatagttgcttatcgtcaagttcatattcctctctgtctgagtcaggattatagagatcagccaaacaaaatatacttgataagcactcgcttaatttttcattgtctttaagacagatacgttggtcacgctctatcctccaaaactcaatgtaagcattcgcaaaaacctgcgctgacactctttcattaataaatgatttagcgaattctaaaataactatgctcatcgtagggctcctgtttaacaaggctggctgctctaccaagcctcaattactcatgtgagtcaatttcgttgagccagcaattaaagtcttctttttcatataaatactccctgtcagttatcggtaaatctgctccccccaagcattgaagtactttccaaacaacctgatcgcttactcgaatgtgatcatcatcaattattgcaaacgcccattcagaggcgcttgagcggtcaagttcccctgacattaagcgccttacctccggcagtgaaatgctctcaacgttaccatttgctaccattgcagaataaatatatagcccggaccttcagcttttcagtggggtttcgctgttggccgccaaagatattatttgccagatggtcaataaaatggagaagcttggcattcaggctagtgcgggaaggtatttaggccaccagcaccgttgataatatcaagcgtagagtgaaaaaagctggcaggtggatgattgaagcaaatacacaaaaagccactgttgctgataaaccgtccaactttatggggtcagttcagctgacagtggccttgattgggtagcgaatacagataaaggggcttcagatccccctaccggttatataacctttcgtccttgcttgtaggcttctttggcttcgttgaggctcattttatttgctccaccgcttctctctggatttttagactggaaaggatcatcttcccaatcgcagttaggacaaatgtcatgttcccctagagcctcaaatactttttcaccacaacacgggcatggatagtcttcagtaatcattgatcgttccaatagtccattttatcggttggtttaaacatagtccttggggcaccattttttgctttaatccccaatgtattactttctggatgataaaaaagctcgtctccattgtttctagttttgtttagcgccccatccggagggttgttaacaaaatcgtgagtcgcatcgacatactctttcgaattagttagttctggaaattcagaaccatgttttttccaatgtccatatgcattttgaaccggagttattttctttctttcagtccagataggatcatctggatttttactgagatagatatacaacggtggcaaatcaagcaacggatggatcagaatataatcgcggaaatccttctcctctggcatgggtaatgtagttgaatgctcgccggtttcgtcagcttccggcatcggtaataccgtaatcgtagtgcgaatgatcggcccgtcgttattaccggtattcgatggggctttaaatccgggatcattcggtgtccacagaatggttggccctgccgcgccatcttcccaaaactcataattgccggtaaagacattgagcgtcatcttgcgtactggcactctgtccaatccaccttcagcactcatatgatagccctcggcttttaaccggccatttccgctatcaacccagcgaaaacgcacgcgtgttggtgctgagccaccattcttagcaatgttttccagcttgagtttgtcgagtaaatcggtttcaccttcattcagggtgcccggcatcattcccatgatagcagcaccgacaggtgatgaacccaccatccagcgtcccgccgtcatcaggttaccaccgacaaaccgcattccctgaatacccgcttgctctaaggccgccagacccgccccagtcgataccggtacaactaccgcggccggagccgcactggttctccccaacacccgcttgtaccacggtgtcttaacatcaggctctgtttccacaggtttacgcctggcagtttgagcgcgttgatccacttcattattatcagttggggaggttggtgaggggggaatagtctgataaaagcccattttgccgaaattgcggtgtggttcaccctcggtacccgcatcggtacaccccttttcccgcagacaagacttggcaaaaacgggggttacgtctggtggtgattcggaggtctccgtgaatgagggtgcgatactggactgaccggaggtaggtgacccgattaactcataggcatcattcatcatcgaagggataaatcttgccttgcacggacagttacttgtgctgtgtagtgaacccgcaaacttgcgtcccagtattgtgtctccgggaatgtgcccgacaatgatgtaggttcccggatgcttaccgcaggtaatacggtcttgttcacgggcgacggctcttcccattattgtgtgggtcggttccccttcggtgataactcccccgcaagttgtttcatcgcccacaaccagataataaccttttgccatatcatcccttatttatccgtttgccaatatcaatttggcaatatgcccaaaaaggtaagggataatgatgagttcggcaattaaaagctgaaaccgtgttctgttgttgagtaaggggatcaaccagcccgagaaaagcctcaacattaacgggttaactttcgaactgtatagctctagaaaaggcgggtacgtcctctacacattgatatgtagatttagccagaaccatgtagagcttgagagaggataaaaaccatgaaatgcttatggagtaagggattggtaggggttaggagagtttgagataattgcgtgaagggaacataacagaaaacctatcaaattgtatttaaacaattattaatttcactatatttttaatacccccaattatacccccagatatttttactcggattagcttaactgaaagataaggttttatcaggcatcagaaagcacaataatcatcgtgatactgttcctctgatgcactgactatcaaaaatctggaataaacccctcttttcgcaaagcatgaatgacaccacgcatcagatctgatttcgaaaaaccggcggtataaattcgcgatcccacttcaaccggttgtaaaaggccacgatcaactaacttaccaatctgataggtaatttgagctggcttcaatcccggcaaaacctcttttaaatcactggtttttaccgtcccctggctaatggtccgcttaagaattttagattccgtctcattgattaccccccgccccttggaatactcgagcgctggataaagaacttttgagtttaaaaagtgaagatccgagagcttatcgactttctttaactccgccgatataccggtaagaacatacaggcaccattgctctagcccctcaacagcccccgtatccgcttcggccagcatcgagtaatagcgctcacggtcattgcaaaaaaccgccgttgggtttagcacccgcccactggttttcacattaaaaccgtactttatcagcaaagaataagtcagcaggcgcactgttctgccattgccattaccaaatggatgaatccaaccaaaacgatgatgtgcgagagccactttcatcagatcatattttggcgcgtctgcgcgattcataaacccgaccaattcctgcatataagccggaacatggatgaattcaggcggcaaatgagttgattgagcaatactcactccgtggctgcgataggctcccggcgttttatccccttcccgttcaagcccatttaccgtcatggcgtgcagttctcggacaaaatactccgtgatatcttcaccagcatgcagatgctcatcaataaagttcatggcatgttcgatgttgccaatctctttcaattgatccgtggagtcctcagccccttcaactttactttcaacgtaatcggctaacgttgtatggttaccttcgattcttgctgaacccaagctttccagcatatgaaaaatactttttagctgggcaaataacagaggatgcacatcagtttcaagacgcaggtgccttagtaactcaagctcggtcaatgcatcaaccaatggcgagtcgaaactggggtttaacagtgctaaatcatagtgattaaatttaggcataaagttagattatctcaaacatgtaaatatcattatcttaaaaatagattaaaaaatactttatagccattatgttaacagattatcatttgtagattatctcaaaagtaactttatgattatctcaaaaatccgtggcgatacatccgattgaatatcactgtataccgaactgagatcagcaccatctccctactactttcactttgaaccattatgttcggtatcattcaaagcagggccaaccagagataacaggagtaatctcatgataaacccagcggaaaagctcaaggcaaagcagcaggaatttatcagtatcagggagttgattcagcggatttcgcgtctccaccccacgatgagtcaggcgcagatagccaactggctgctgatagaattgacggatgccaggccagtttcaccgccgttactgattcaggacacgctcggcgtgacccgctcccccggctttgatgacccccaattttgctattttgatctgctctcggcagcgatggccaaccctaaaatggatggagcgccttgtgatggatggatacctgaaagttataaacctgacgaatttaatcaccggcccgatgaggaggatgatcacgaacttcccttctaaggtattaacagcatgaattgttatgattacgtcggatttaaccggactgaaatagaacagcttttgcagattaacctgcgtgacagtgacgaagaatataaaaatattcttaaagataaattaccaaaatggttaacgccatttctatccagaattaatatcacaataaaagaaacggctgcactgattgttggggtgatgccttattctattcaaattgatgatataggaatggtaataattaattatgagaaatcattatgggatgcagtggattgcaacctattaagttgtcgggatattagttatacaaatactaataaagatattcgccatgacggttatttattaaaagcagaagtggaaggctgggttaaggcgaatggatttcactggccgctgcactggtgccggagcagcggcaagcagaagagagctggggtggttttgcccgcgctggcgtttattgccggtatggctatcgcgttagccaggaacaacccgcagtgccggcgcggcgtcaaaatgaataaaaccgccattgcccgggtagcgactcaggctatgttcaacgcgggattcagcggggaaatggtgaccgaaaagcaaatgagtaacttgatcagcgaggcgctgcttgtttctctgcccggggccgataatccttagacgagcggaagtttatttccaactcgccgctatgggtttccaactaacatattcgcgttacggattgacctaaaacgacaggaataaaggttccttttatttatttgccacttacccctattactgcctgattttgtttcaattaattcagtagccaccgagagataacaggagtcatggaatgacctattcatcattaatccgattgccagaagtattaaaacgtaccggttttagccggccttgggtttataaattattaaaacaaaagcgcttcccgccaccgataaaaataggggggcgggctatcgcttttgttgaaagtgaggtgaatgactggattgaacagcaaattgcacattcacggggaaataagcaatgagtgcgctggtgcattattcggaatgtattccctttaacgtttcatcaatgatggcgaaatcctggcgctccagccgctcatattctgccctcactgccggtttctttagcattcgggcgaccacttgttcatgggacaggcttggtggttggcgtttattatccaaatcgcaactccttcattcgtttagcggctttgcctttccctttccacggcatataagccgttttttgcaccacaatatgcaaaataacaatctgccagtctatttgtgccataaaaatgacgcggttccagcctttcggctcataaaaatacagctcaaacacatcttcgtggtaatgcatcgggacagcatcaaccatcttaataccgtagcgcttcatacgtttagccaggctaataaaattggcctgcaagctgatgggttgggcaagaagctgggtgatgacatcatcatcgtaatattcaatggtgtagttcataggctaaaaaataacagaaacgttattttcctccggctgcggatgtatcaaaaggaacgccccgacatcactcaatactgccggggcgtttatccaccacggagcaagggtggcgcggtggatacagtgagtctacgaatattcccgttgggtgcaactactggacaatagaatcagattatctgcatctcattgatacataaattgtatttataaaatttaaaacattgctatgggtgttaaaaatggcccgaaaatggattttatccgccggaaaccgggcgtaaaaaggaaaagtcatgaatcaatttattaccgaggttgcggcacaggcgcgcggaaaatggggctttattctggatgcgctggcgatcagccacagcaaacagcactccccctgtccggcctgtggcggcaaagaccgctttcgttttgatgaccgtcagggcgcgggaacgtggttttgtaatcagtgcgaaccacaatccggcgacggtttggatctggttaaaaatgtccgacaatgctcgctaactgaagccgcgctgctggtggccgatattctcggtgtctcacccaaatctaaagcgccggatctggcctctctcatggcgaaaaccacgccaggggaatctcgctatttaattaataaaggtctgagcagccataaattacctattctgccggatggttcgttattgctgatattgcagaatatggcgggggactgtaccggcgcacagattatccggcccgatggcacgaaaaagctgatcgccggtagccgcaaaaaaggcgcgtttatcccgctcaaaccgctgccggaacaggctgaaaccgtgatgctggcagagggttacgccaccgcgcaaagtctggagttattgctaccggccgccgtgattatcgccgccatcgatgccggaaatctgttgccggtggcacaggcattccgtatctattggcctgccgcgaaaatcatcattgcggcggataatgatatcaatccacaagacacagccaatgttggccagttgtccgcagaaaaagccgccaacgcggtcaatggttgggtgacattgccgccaaccccgcataaagccgattgggatgattaccgtcagcaagccggtaccgggcaggcgcgtaacagtttttatcatggtttgtatcagccgccgccggtgagccaattggctgaaaacaaagggttgcatccgacattatcgcaaatggccgccagtcagcgcgggcagttattggccgaacattatggccagattgcggtgcatgccgagagtgaaacggtttatcactatgatggcgagcgctgggacaagctgcccgatggtgtgttacgacgcgagctggtgatgattttcaacgccaacgacacgccctattcaccggccggtatccgcaatgccattgaagcgatgaagctgcaaatcccgatcatgggcgagccaccacgccatttaatcggctttcagaatggagtttatgacctgaaagccaaacagttccggccgcatcgcgccaatgattggttgcagcatcataacgacatcatattcaccgaaccgcagccagacgaaaatctggcacaccacgccccccatttcaccaagtggctggcccatgcggccaatgacgaattgcccaaaatggcccgtatcaaagccgcgctgtttatgattctgtccaaccgattcgactggcaattgttccttgaggtcaccggcgagggcggcagtggaaaatcggtattcacctacatcgccaccttgctggcgggccgccagaacaccgcctccggcaatatggcggcgctggatcaagccagagggcgcgcgcagtttgtcggcaagagcctgattacgctgcccgatcaggtgaaatatgtcggcgagggggctggcatcaaggccatcaccggcggggatttagtggaaatcgacggcaaatatgagaaacaattcagcaccttattaacggctgtggtgctggcgaccaataacgagccgatgagtttcaccgagcggcaaggcggtattgcccggcggcgggtgattttcgcgttcaaccatcccgtgaaagaggcggataaagatccgctgatcggcgagaaaatcgcggcagaactgccagtggtgatccgctgcctgctggttgaatttgccgaccaggacaaggcgcgaaagttgctacttgagcagcgagattcacgggaggcgatgggggttaagcgggatgccgatccgctttatggcttctgcgcgcacattgtcgagctgggcgaggcggtcggtatgtatatgggaacgctggcaatttccccgcgcgccccgcgcatttatctgtatcacgcttatctggcttatatggaggcttacggccatcagcgttcattatcgttgaccaaattcggcaaagactttcccaaagtgatgaaagagttcggcgcagaatacaaaaaagccagaactgacaaagggttccgctacaacatggatttatccgacaccgccaatgactggctccccgctctggcactgccccaccatccgcaaccggaagaaccccactaattatttctcacctctggcttattcagagtattcagaaatagatttaattaattgaaatacaaagataaaaactgactgaatagtttactaataactgttcagtcagtattcagaggtgttcattaattcatggatggcaggtattaaaaactgaacacctgaacagttgctgaagagttcagcggggagtattcagagggggcgaggccagagtgggtgcgggttgtgggggggattttgtaggttggtgaagggggtgaagggtttttgggggaaatcactgcgggagatagttttcaatgaaatggtaaaccgcgcgactaaaaaattggcgataatatccctatcccctcgcccgcaaaaaatcacattacaaagtatcttgttgcaccctaacagctacctaatttcattcaataactccgggtgtttatcaagcacttgcaacagttttatcgttgatggatgtggcaaagccttacctttttcgtaacgcgaaaatgcattaaccccaccaccaaaaatctcactggcttcccgctggtttaggcccaacttttttcggatctgcacaatatatgcgggggcaatcgattctgtattgaccatttttcgcaaaagcattgtttttgctgcatagacatcggactcggcttcggtcatgactgtttcaccgcatgccgggcaatgttgccctatcacgccttcgacgatgaacttacgccctttataggtaaagggaacgtcacgcgcttcgtggattaattctacaccgccacaaactggacatttcatcattaaatctccttaaacgagacaatcaaaacatcatcgataaccgtgattttcaaataaactctaccgcaagaaagcataggacggtaaacatcctgccaaatggtatgatcttgatgtgtcgtcatacttttataaaaatcggcgctaatcagttcggaaactgcatcacacatatctctaaaactcagtcccagttcctcagccccatctctggcagttcgtgtcgttttaatattccccttcaataccaattcttttacttttaataaacgagtatgcggagtccgtttctccatttcattgccatccttgagcaatttccacttaataaatataacctagtaggttatttatagcaagtcattaacctattaggtttgtttgtgagcgtgatttaactattattaattagttatggttattgaggtcaccaaagcctctaatttttatctttagcactcacaaaatcatctgcgccgcccggcacttataaatgaccgctagcttctctctggttttcttctgtgggcgagaatctacggcttcccattgggatacagcagattgggtggtgccaagcagttctgctatttcatattgcgaaaaaccacggtagatacgccatgcagccagcaaactgacaccatcgtttaccatgatttgaacaacttcattcgggatcgtctgatcatcatcgttatcagcaacatagggaatatcctcatactttgcattagagataagctgctggtattcggcaacgggtaaaaccacaaactgaggctttcctgcttcatcatgaatgtattgtagttttgccatcttattcaccttagtttagaaaaataacaccatgcctttgagggaaaatatactgagctaacctaataggttgccgtggttctacgtttaacttcctggattgtacatatcacaggtgttccctctacaatctgaaagataaccctgtaattccctacacgcatacgaaattggctatcacccatctgtaactttttgatatccaaatcaacagcagggaaatttgtcagtttattcactttttcactgataggtttacgatatctggcatctattgaaagtaactgcttaactgctttcctcgaccagtcaaccttgaccatcgtttcctcacttttgtaagtgatcacatccgctgttatggtgagagagtagagttatatgtaagcaaggtcaacacaaacaccttattattaactaatctttaccttatcaaaaactgattattaagttcagataataattgatatcgatgggttacatacgcattacacccataaatgcggcccctctcgcatctacaaaaatgtttgtcctaatttaccacgggttaattgaacagtagggaatggccggatatagtgcccccgcagcggcaaaatccgttgctgggtttagcagcctgagacaaaacagagcgcacaaccgcgcaggcggttactatgtgcgggtacagttacacctgtgaaaaacaatggtgggctggacgggggcatcgaaagatgcgccgggttctctgttgaccggtctgctaaccccgttcagtccaccacccaaagggattagcagctcttggtggtgggataaagccatcaactgagaggttgtcatcatggattcgacgactcaagccccttgccgtaaagcttttcttcacctgccaacatcactggccgccactctcccgccggaggtgcgccatgtacgataatacgccccgcgaagtggaagaagtcattgatcactgccgtgcactgatctacgccatcatcacactcgaatccccggaagtgaaagaaatactcaactttgtcctacaacagcaaatagatctgctacatcaaacttatcatcaagccaccagcgagcctctcgaggccgaataatctctaaatacaaaaaggcatcgtgagatgcctttttaattccccacaccaccggcgcggcgcggagaatcaaggagttgcagatactacaagccactcaaagtacctttaagatacccgtatgtggacaaaacgtggacactaaacagatgttttcccctttagcggattgaacgaaactgcatcttgcaagtaatcaggtgaaaagtgtgcatagagcattgtttgctgaatagttgaatgtccgagtattcgttgcaatgtaatgatgtttcctccatttatcataaagtgagttgcaaaagtgtgacgcaagacatgtgtcgcctgaccctggggtaggtctgtcttcactgatttcagtttttggcgaaatatcagatatgccgcatcattaaacaacaatcctgatttcatcgctgtcagatcgttgaacacatcactagatatggggacagtccgttgcttgccgttctttgtcgcaacaaacgttatcctgttatcaatgatgtgttcagtccttaattttatcgcttcaccccatctcgccccggtactcagacacaaaatggcaacgcgtctattatcgccatccaggcagttaagcagtttcttaatttcactctgagacagaaacgccctggctgtctgttttggcttcaatttactgatccctgccaacgggtgttcggagtgatacactcccgcattaatcaacgctgtaaacattccgctaagaaccgctaaatctctattgacgctagacgctttcacgccgccagccaggcgaatcgcgcggtatcttgcaatgacgtttttgtcaatttggaaagcacaaaggtcagacattatccttatgactttagccagttgaactttatacttttgtccatagtccatattttgaccgtggtatgaccaccacagggttgacagctcagagagggatcgcttgtctgtcggttttgatagccattctttctcgtgataattgacgaccacgtatttttcaaacgctacagcttcgtgctttttactaaacgtccgcctgatccgctttccgttgcgaccagccggcctgatatccacaacatattgaccatcatcaagtttcttaatcgacataagaaaaccctccgatgtagaaattattttgaaacgatatttcaaaaatgaatactttataaatacttaaccagtctttttgtctgatgggcgatatattgtttcgtctagcccacagtgtgcgagggccggtgcaatctgaccggactcaggggctatctgatccgtaaagaaccataaggcatatttttgaaatctaggatggttcagtaatttcatcgcaattgttgtatctggcacagttcggccactttcataataacttagtgatgagtatggaatttctgataattcagatagttgcttccgatttagcctttctgactcacggatgagtttaattttttcaccaatgctcgttgacatattatcgatacctcgatattttacgtagtaattgataaacacaatcaataacttgatagataactacagaccattacaagtcattgacggaatcccgatactgaggttatcagatgagcaaacaaatcgtaagcatgtcagatgcattgccctaccccgaatttgcccgtttgattggcaaaacaccggaagcagtgaaaggcatgattgataagaacaagttaccgacagttgaaatgcgtaacccagaaaacccaaccgcacgcggtgagcactgggtttacctgcccgcttggaacagcggcatgaaattagcattcgagagtagaccgaaagaaattcgagatggctggttaatgtggttggggttgggcgacccatcatgatctactcgtcactctacgcactgaccgtaattagcgatcacaccagtgcttaccgtagcttttcgattacttgctctaagcgcaacaaaagaaacccggtcacccgttaccacgttcgccagggtgatcagtcttacgggaagtttgacgcgctagcgcaggcgctggaatacatcgacacgctgcatgaaatgaggaacgcacaatgaaaaagtcactaattctacggctaactaatatcgtgctgcaaaaccatcaatttgccagcgatgcattgtgggcaagtttccccggtgctctcagttccctaccagatcctcatcgggaattagtcgttcagaaatacagtgtcattaccgaaaataccgtcgttaacttggaaatgttaacaacgctggccgcgcaccccgacgagattggccaggcattaagtgatgctattagtgactttaaatcatgcggggtgctacctgaaatattgaggggataaagccctccctcaaataacagatttgcgaaagggttttatctttatttacgaaatgggattgtgaaaatgaaaaagttacaaccgtgtgatacatcgaaagaaaatagccccactcctgaggctgaacttacaacatcttttatttttaaaaatctacttggctatgaaatgggatatctcacagtcgaagagagcgttttccaccgtcgatattattcaggccatcaattaaatcctgaataaggtctgtagccatttcaggagttaaagcatatggcggtgtatcgtgccccattagagttccgatacgtgtatggagattgcccatgattacgccaataaacttatttcctgaagcatcagacatttctttgcactcaagctccctcgggaagattgcttcaatttccatgcatataactcctttttgtgggtggttggtatttgcgccggggttccttctcacagtattaaccggcgcaaaaacagtaccacaaaaaacgcgcgccgggcgcgatgcagtaccccggcaccaattcaattgacggagatcactttatgagccagcaactacctttttcaatcgccgctaatcaagtgcttgcgaaatataaatttagacagactttcgtttctagccgctgggcggctaaacacggaattggagagattgtgtgggcggctaaccagttgctggatctggccggtgtggcttcatattccggcagcgaagacgccgatctacttcgcgataccgcccatcgctggctcaaagactgcataactccgcaagaattccctgaacataaacaggaaatgacagcatgaccgctaaccaatgcccgccactggctgcaatgctaacgaacggtcagcaagttacacaccgccgacacatgcgaggctggattgagacgccagatggccgtagttttcagcctaaagccagcgaagtgcagtttgttaagggttgtcgctctccatttatgacaaaacccaaggctaaaccccgcttttggacgcgccttattagcttgtttttgtagccggaggatttatggcaaacactgaaaatacccgcgcggtaactttgtctttgaaagcccgtcaaaacggtttaaaacacgccgcccagctttggtatttgctcaggaacaaaaaacaccagggtattattccggcactgattaatgaaatgggcgaaacagacccaaaaatgaaaggtgccatttattatctggctgatattccacgggccaggcatggattagcatttaaagaactgttaccgcaggagcaagtaagtgtagttgatgcactaaacagatggagggcatcagccagtttattaccggagcgagttacatatatagattgtgatccgttgccggataataatagtaattaattaaacacctgaaattaacaggcgctatgtggcgtcgggattcccattatctaaaaccggagtaataagaatgagtgttaaatcgataaaactgactaacgagccaaatgacacggaactggtcgagtgctttaaagcagctcgtcgttctgagcgtttaatgttacttgagcggctagataataagctggctgattttattattgccggaacgcctaaggcaaaaatattacgtaatttatctgattggatttttgaaagtaaattaattgctaattcacccactgaaaacaaagaggttaaataatggctactcatattaatactgccaatgcaattgaagggctgacttgtgctattgatacctttaaatatattgagcaatatttaaactttaaaatgaaacaccccattcagtatttaacgaataccataactgaaatagagcgacttaatgatgaagcaatcaggttaaggaagcgtattaagtttttagaggaattcaattcctcattcgaatctcaatgggatgatttgatttttgcggttatgggtaccgaagccggtaaacgtatctgtgctgaaggggctgatgaaacaacaataagggcagtcagcgctatccgtaaaacagagtttgacagaaaagaagccctgtgcgtagcccaggcatttcaagagacagcacaatctcccattcctgcgccagcaccaaaaacacatcgtttgaaaatcttgcctgaatattttcagtcagttattgaaggtagaaaaaaagcggaactgagagtaaatgaccgtgatttttctgtgggggattatttgcttttaaatgaatgggatagcggggctgatgaatatgccgggcgacaggttgccgtggcaattacggatatcacccacgtggatagtcttgcagataatttagttttgctttcattttatgatccatctgacgaaattccattttaaggggctgtcatgaattattcctctaaagaaatatttatatcagcttatgccgcaatgaatacacctgatgacataacattacgaaaattaaatgatctcatcaaaccggctgatgctctttttttgattttagaaaatgaaaaatacaaggctaaagaagttgcccagtcttggataaatggaaattatcttattttagatacggaaactactggccttgataatgcggccgaaattgtggaaatcagtattatagattgtatgggcaatgtattgctggatacgctgattaaacctctcggttttatcccctcagacgtcgaagccattcacggcattactaataaaatggtggataacgcgccacactggtgtgatattcacgaaaaatttatcgagataattaaaagcaggaattttgttgcttataactcgcgttttgatacccggcttatttatcaatctgcggagttttcaggcgtcactactggcgcggatgatatagcgtcagcatctggcaattgtgcgatgttggaatatgcccgatttcacggccagtgggatagccgccagagtgattttaaatggcaaacgcttattgccgccgctgggcaaatgaatgtcattactgagggcgcttctcaccgtgctttatctgattgtaaaactacgctgggcgttattaaagccatggcaggcggtgaaatatgaatatacccccacgccacggaaaaccctggtcaccggaggaagtagcttatttacgcgaaaaggtaactacaacccgctatcaggatattgctgaccatttgggtcggacattaatagccatttgtttgagggcgaacgccgagggcgtaaacccatcaaacattggcgaatgcaatcgaaacgccaaacatagcgatcatgacgtggagttatgccgggcgctttacgatgagggtatgaggccccgattcattgcggaaaaaatggaaatgccggtcaatgccgtatacggaatcatttattacagcacacgtcgaacacccacacctggcggctcattccagcaatgaccagtaagcgcggcagatttcagcccaccccgccccaaccttaccccggcagcgatgaaacgtttgccggggtttactcttggaacaaatctaagtccagcataaacccacggctagatattgatctgcccctccagtttagccccctgtcgttagtcattgatgcatactataaagacgcgaaagccgcgctggcgggcattgatgctctacttactgacgacgagcgaaaagccagggcgaaacgtcagcgatttatagaatgctttgaagatgcggaagaatcgcgagaactctttttagcacgactgactgaatctaaaaaagccgaacgtcataaccgcgctttagaaactcaggccaatctcaatagtcaacataaatttattcgtcagccattacagcgccgcattgattacttacgtcaagaacgtggcgacaaacaggccaatgtttttttaaatcaattggttgagaaagcattattacgtttggacgcgatgagagtaaagcaacaaacggtatcactccgacacattgccaaccgagagcggttagacggtctgctcaatttggccgcactcaataaaaaagaggtcactaccctggcaacaatggccgccgcgcacatggatatgttacttgatagtcagatggcaaccctgcccactgaaaatgccacgccgcgccagatattacgcctctaccacgcgctagctaacgaagctaaaaagctatcaatcacccccccgaattgggacgccctcaacgataaattgcgccgtagaggtgaaataccttatgacctgatccccggtgcgctggctcgcttgcgttgcgcgacgtggtggagaggccggttatggcggctgcgttgtcagtggcgagaggaacaattacgcgctgtcatgttagtacacaaacacgcgtcaccctacatcagctcagaggccttgattcagcagcgtgagcagtggcggcgctccgctgagtttatccgtgctcatgatttagttaatgacgccggttttgtcatgaatatggaagacgtagttaacgccagcgccagtaacccacacttacgttatatcgaaatgatgacgacctgtaagggtttagaaaacttggcagaaatgcgcggggataaagcgatgttttacacgatcacctgcccgtccaagtatcacgccacgctgaaaagcggcaaacgtaatcccaaatggagtacaaaaactgtcaaggaaagcagtgattacctggtcaacctgtttgccggtatcaggaaaaaactcagtcgtttgggtctgcgctggtacggcgtccgcattgccgagcctcaccatgacggcacggttcactggcatttaatgtgcatcatgcaaaaacaagaccgcgccgcaatcactcaagtgatgcgggattttgctatccgtgaagaccgccaagaattagggcgggatattaaacctcgctttgatgttaaaccggtgctcaaaagcaaaggcactatcaccagttacttaacaaagtacctgggtaagaacgtgcgtggcagtaaccttaaggggaagttggacaaagcgaccggtaagccgattgtcagtaaagaaaccgggcaaccattgggcgaagacaccgaaagagcggttgcctgggcttctcttcacggcgttcagcaattccgcttttttggcataccttcccgccaggcataccgcgaattacgcttattggccggccagcttcaacgccaagccaagccggaacaggggaagtggaaacaggtattacctaataaagcgatggatgatgtgctggccgcagcggacgccggctgcatggcaacgtacatcctaaaacaaggcggcgttctggaaccccgcagcaaccatctgatccgcaccgcttacattgaatccgaaacccccaacgattacggcgaacttggcaccaagatttatggcgtctgggcaccgagcctaggcgatgaatctcggatatgtacccacgctgacaattggaaaatggtacgcaagacaggcagcgacgacagccaaactaaggccagcgaagcggccgcaggggttgacctgggttttgattttgcagttggggccggcggtatcggcccttggactcgtggcaataagtgtcccccccccgccgacgaagccccaaaacagcgtaaaaaacggacaacgccagcgcctgatctaagcgatttcaacaaaatatcgttcacccagcgaagggaaatgcgcgaaagattgcggaaattaccgccgccgaggctcggcggtgacgacgaggacgtaaaaccccgaactcagccggccaatgcgccaataccttcggctgaaatgtgccaaaaaatcgaccaggcggcgcaacgtagcggctggatattggaaaaacggcaaataagcacgttagccaggggcggaaatgtgacttttcccaacaaaatgaccgtaagagtagaccaagaacgccgggaacaaggggaagtgaagttaattaaggcgtttgatacacatcgagcacagacataaccgtctatgcggtaccgattgccatgcaacacagccggttatgactgtgttggccatagaaatattacctgcagcacagtcatttttaactattgaggttcaactgtggaaaaaataacctacttgggcagcaaagcggctagcggggcttatcaagtgatatatgtcacatttcagcatttagcccataaaaaaacccgctttcgcgggtttctcaaaaaaacgatgtaaacaatcatattatgattaacttatacagaatcataccggctgattttgcagtaaatctaaggctatctgcctttcatccggcttcaacatttcaagcaaagccattaccaacttactacccgttaacccgctgggactgagtgagtgcgagaataccgcgttaaatacaaaggtatggccgcactcaacattggaacaggcacaatacaaatcggcaacttttacgtctttccattctgttttgcggataattgcgggtgcgcggcattctgtgcatttaatcttgaacattcgcatattaaccactccgaaagctatttctgttaacttccgtgattttagcttatttttgctcaattttcgcccctttcggtgttatccgtgtctttatctgctttaaatcgcaggtgtaaatgggcgggtgtctcgggatcggtattcacggcacgcataaacttattttgtaccggaataacttcatctttccggtatgtggcgcgggccttctccgggtcgcccatcacggtgccattgggggggataatccccgccaggcctgacgggaaacggtgtgcggtgagaatatcctgggcggtgatgcttttaacgttggaaaactcatccttggcgctcacttcaccaattgatattagtttaatgccgtcgggatcacccttggggatactgataaacatattgcggaagttacccacgcccttgctttgttctattttttcttttatttcccgctctacttccgtgctgatgctggggtcattggcgtacaatataaaacccatatgtgcgccattatggtaatagcggcggcgaaatatcgtggcctctgaattaagcagtaccgagtgaataccgccaatataatctggtaagccgtaaatttgttgctggggatcgtactgcgccaaaaatataatatcttccgggggataagataacggctcatccttttgtaaaacgacaaactcacccgttctgcgccgacgcgtatagagtgagggcagcggcaccaggtcaataacctctccccaaaaattccgcactttcaagatagccacatcaccaaaaaggtaataatcaaacgccgcgccctcgatattatcagttgttagcccaccgccgaggtagtcgctaaccaacatgttacgcctggcatagagaacgccaccatgttggccgttaaggttcggcagctgcgccagggcgaggcgttcaatcggcaatcgccagtggtcaaaatcattgtcgtaccatatttcactgtagtccgtgcctgtggttaatatcggttccggctccccgaaagagataacactgccccgcccaggggtgaaatcctcggttgccttggcttttttttgctggctgctgttctggcgtccgcgtttctttttagttgtcatgctgcttttccaaaggcccaggtagacgggcgatcatattcatagtcgaggggttcattaatcacggcgtgagaaatggcgaaaaatacgtcggcgtgaccggtcgcgtctgaccgttcggccacaaaggtaagcgcattgccgctggcagtggtggtgcgtcggatggccataaagctggcggcaatttcggctcgctcctgactacattcatccgtcgcgtccttgctccactcaatacggccacgggaaacggtatctatcattttcagcaccaggcggtttttactctcaaccgtatataaaataggagtggcttcacggggcgcgaagcgttcaactaagtcaaataccccgcgcccgatgccggtgatatcaataccgatataagtcatgttatagcggcgcatcagttgcttgatttgatcggcttgatagttaaaattcagtccttgccagtaatacacggctaacacccggaaccgttcaccgtcatagagcggcggcgcgacaatcacaaaagttgagttatcgccggaacgggacgggtcaaagccgccccacacttcacgattaccaaatggcctggcggctttggggtcgtggtcttgccacatgccggcatctaccgcgcatttttccagttctgaaaacttgaataccgcgtctttgctgtcaacaaattggcacatgtacagcatggcgaacgcggtcgcattgtatttattacgcaaccgctcaatatcgaccaaagcacccagcccgcccttgatcgcgtcttccatcgtgatgatgtagcgccattgatcatccgggcaaagaatcccccctttacgcagttcgctttctttcgggaatatggcctttttccgtttggcgtcatcttcccgccaggtatcccccgtccagatgggatacgccgggtgtgttttggcactgggcgttgaaaagtaagttgtgcggtatttgttatgcgttgccatggctgacgcggtttcgtggaatttcccaaatttgggtatccagaatatttcgtcgccgtaaagatggccgttaaaaccctgagccgtgccggcattggtcgacaagaaccgcagcaccgccccgttacttagtttgattgggttaccggtcagcgtaataccaaacgcctgttgagctatttcgacaatataaaatttgaagatttcagactgtgcgcgagacgcagagaaaaacacctggcggtcaccggttaacaccgcatcttcaaaggcttcaaaagcaaaatagtaagtcatgccgacttgacgcgatttcagaatgtgccggaagttctgctctttattggcgcgacaatgcatttggtaatcaaacaggtgttcactggcccaactatccaacatttcttttgtgatactggaaatatcatttttgcggtatgaacgtttcctctcgctgccgaatccggtttcatcctcgccgccacctgactgcatcgccatgcgtgcttttatttctgccatcttttcagcgtgtttattaccttgcgccattaatttgacatggtgcgcgaccaggtcgcggatctcttccaactccagcgcggttttgttatcgcgccgtgataactggtcatgccggcgcgcaatggccgattcaaaagattcaaccggtaataatgatgcccactggcctatatcagaccaatgataaatggtgcgcactggaatgtttaattcctgcgcaatatcttttggcgtccaacttttaatataaagtgttcgcgccgcttcttttatttcatcagaatattttgccataagtcgattatggcgacataacacaacgataaattataataaattcggttaagttacgttaacaacacttaaccgaatttattataagggaataaccacaccgcatttaaatatccgtaatactgcaaatcacacggtaattattcattaaccaaaagtataaaggtatttcatgcctcaacttatttcagattggatttgtattggtacctctggaacgtctgttgacggtaggccattagagccgcaatggttgattgaatgcgccaacacttacagccgtgagacttacaccgccctgttgtggccgtaccatgaagaagatattactatgcggcaatacaccccgaacatgggggaagttgacgccttaaaatatgaagaagtgggcgaaaaaataaaactttatgccaaattaatacccaatcaatttttaattgaggctaaccgacaggggcaaaagcttttcacttccgttgaaatagttcccgattttgccggtagtggggaaagttatttatttggtttggcggtaaccgatattcccgccagtttaggaactgaaaagatatcctttactgctaacggtgaagataaggcggtaacgcgcggtaatgtcgaagcgtttagcttaggccaattaaaaagccgtgaaagtaaaccggaaaataaaaagtcgggtttctttggccgcatattttccattaaaaaagaattcacacccgaacccgacaataaccagcccgaccagggcgaggatgaaaccaagatggatgaattaaaagctcttattgaagcgttgaccctgcgtattcaacaaatggaagaaaaagccaacggtaccaccgctgatacaccagaagaagccgccgacgatgtggccgatttggctggtgagattgctgacgtcgccgaccaggtggctgaaatcgctgccgaagtagccgacaacccagaggatgaagtggtcgccgctgaattcagcgtggctaaaaagaacctgtcgcgattgatgaaatcctttgccgccaatggtgcgccagctcgccgctcccgtactcgcagccacacgcgccgcgccagtcgtcgccaggattttaccgctctcaccaccaagcctgaatccaacggtaacgaattgaccgacttaaaagatcaactcaacaccctgctggaaaaattcagcgtattggatacacgtcaatccaagcttcccaacggcgccccgaacggcagcaatcagcctttcgactttaactagtcgttattgaccacctttaaacgggaaaaagaacatgcaattaacccccaaggcggaagcacttatccgcaaatatgcggccggtttagccaaggccaataatcagccagatacgaagcaatttttttcgctgactgacccgaaagaaacctcgctacgcaacgcgctgatgcaagaatctgaatttttacgtctaatcaatatgatggatgttgaccaaattcagggccaggtcgtcaataccggtaatccggggatgtttaccgggcgtaaaaaagacggtcgtttcaatcgtgaaatgggcatatcgggtaacgaatataagctggtcgaaacagattcaggttcttatctgacttacgcgcttttagtggtctgggcgaactctggcagtgaagacgagtttttccagcgtatccaggcgtttagtaatgaatcttttgcgctggatatgttgcgtatcggatttaacggtaacagcatcgccgacaataccgaccctgtggctaacccgctcggccaggacgtaaaccgtggctggcataccatcgttaaggaacgttcccccggtcaaatcatcactgatagcgtgattttagaccgcaacggtaccggctcggatttcgtttccctggacgcggccgttaccgacctgatccacagttgcatttatgaacccttccgcaacgacccgcgcctggtggtgctggtatcggctgatcttatcgcggctgatgcaactagcatgatgaaccgcattgaccgcccgactgagaaggtcgccgcgcagttaattaaccgcgagattgcgggccgtactgcctacaccccgccgtttatgcctgaagggcgtttgatcgtcaccacgctgtcaaacctgcatttgtacacccagcgcggtacccgtaagcgcaaggccgaatgggtggacgaccgtaagcgctttgaaaacaactacctgcgcatggagggttacgcggtggagtatgacgagctgtatgcggcttacgatgtgatcaccgttggcgacggcgttcttgaagaagttaacggaggcgaatgattatggccctttccccttgtcagcgttaccgccgccgcgttcaggctgaattggcgttaaaaaaccatgaagccctgagcgccagcccggccagcctgcacttacagctacgtgaactagacagtgatgtgacgcgggtgcgcagcctgggaacgattgccgaccgtgtggacatgaagcgtgacgagctgttgccgaagtggctcccgaccgttgagcgctatctggacagcggcactgttcacgatcatccggcctttgcctggtgtgtgatctggttgtttgacgtggggaattttgaccaggcgctggattgggccgatatcgccatcgaacaggggcaaagcaccccagagaacatcaaaagcacctttgccacctttgtggcggataccgtcatggtctgggccgagactcaggcgtcactcggtcacagtattgagccgtactttagccggacgtttgccaatatccgcgataaatggcggttacatgaagaagttaacgccaagtggtacaagttcgccggattgctgttactgagtgataaatccggtaaaccgcttgccacggcgatcgatgatgtagaaacgctgctacaggctgacgcattgttggtacaggcgggcgcctttgatccgaaagtgggcgtaaagacccaccgcgaaaaaatcgccgcccgtattcgagcattacaaaaagtttaacgactaccgcaagccggggcgggcgcgagggagacagaaaacccgtaaggttttcaaggtcgtggatctcggtcagcccgcttcccattttgcaaataaggggttcacgtggcagcaccatcattagggtttagcggtcggcagattgaataccagaacgcacccattgttaacggtgtgacattttggcctgacctcaatcttgccgactttcaaaagtcgcgcactatcccgccagagctgccggcatcaactgccgcgcaggcgttattagccgcgattgctgaaattaatgatgatgttgccgacgtcgtggcctattggcaaggcaaaggccacgccactgcactggatacgccaggggcaaaaatggctgatgaaaatcagcttaccgctcaatacaaaaaggcggtctacgccagggcaaaagcggatttacttggtgagtttgccagtattggccggcgcgaaacgcacccagggcaagagagcagcgaaacccgcgccattttgctggcggaagcggcgtttgtgcttcgcaatatgaagaaatttccgcgcgcgggggtgcatttgatatgagtcagatagagagccttaccgcatttttaactgagtacttgcccgagcgggctatgcaacaatttgaaagtgctattgataacgcggaactgattccagcccctaaagccctgggattagaccagcgccggctgggcatttttcgctatcacgccgtattgaactggggggcatttccttatcggctgtgcgctcctgccgaagtctacgcgctggtgctggcctggctggattcttgtcgtaacgatatttatgacgaattagagctgaccgccccgagtgtagatattgaatttgatgaagaaaattcatcaccactcgaaatcgtcgtggagttggccgacagcatcaatattcgcgtagacgaaaaaggccgaattccgctgcgaggccaacgctggtcgctggttaaccctgacatcatgattgctactggcggttggctatttgcgggcggggcagtgagcgcgccgctgagcgatacgttgtgatcgttcgcggggagttggaccggcgtcagtatcaacaactgcgggaagctttaagagcgttagatctgccccccaaaaaacgtcagcgcttgatctggcgcattgccaagctgggtgtgattgtcgcggcaaagcgtcatcaacgcaatcaaacagacccttttggcaacccatggccggcgcgcaagcgcggaaagggaaagatgttgcgtcagttaccaaaattgatgcatgtacgtgagatgcctgcaattgaagctgtgcgtatttattttaaaaacggcaatagaaatgaccgggtttcagcaggattgatcgctggtgtgcatcaagacggtgcatctttttcgatgagtgctgaccgcgcaccccgtgctgaccagcgcaataaatcggcgtcaccccgccaggccaaaagattacgttcgctcgggtacaaaatgcgcaaaaacggtaaatacgtcaaagcatcaagcgcacaaatacttaacacgatgagccattcgcaagccggatttttgataaaaaaactcaaaaacaagccccgtaaaaccgcctggcgaattgacataccttctcgggtgtttttaggcgtgaacgatacagagtttaacaacattttagttcgacaacttcaagcgattggttttggctaagacattaaaagaaggaacagacgatgacattccccacagtcaatataaatcaacttaatcagcgacagggccgaattaacgaagtagagcgaacattgttatttgttggtcgcgcaaatgaaacagcgacaacacccggcgacttgatagctctggactcacaatctgatatctcgtcagtcctcgctgatgcagatactgcgctacgtgaaaacgtgcgggccgctcaactcaacggcggacagaactggcaggcttacgcgttgatcatggccgagcatactcagcccggtgacgatatgttagctattttaagcgcccagcaaatgatttctgttgaaggcattatttgcacaatacccatcgttaacgcgattgacggccgcacgaaaattaatttatacgccgcgttgcgtgctgaattaacaaacaaatacgggcgctgggcctggtcagtgttgaccgtggccgcacccacagacttgctattgcccatgacctggacggcttatcacgcttttctcgctgagctggctgacgggcttgccgccgaatccgtgcagttggtccccgcgttgtggggcaacgaagccggtgtactggcggggcgtttatgtcatcgcagtgtcacgattgctgacagcccggcgcgggtaaaaaccggcgcgttgattggattgggtattgactcagcagaaatgcctgttgatggcgttggggcagaaattaccctggcgcacatccgcgccatgcatgacctgcgctacagcgttcccgtgtggtaccccgactatgagggcctttactggtcagacggtcgcacactggacgtcaccggcggtgattttcaatcaattgaagacttgcgggttattgacaaagtcgcgcgccgtgtgcgcatccaggctatcagcaaaattgcagacagatcaatgaacagcacaccgagtagcatcgccgcgcaccggactttttttgctcgcacgatgcgtgaaatgtcacacagttcacaaatcaataacgagacgtttccgggcgaattgcgatcaccccagcccggcgatgtagtgatcacgtggtcggatattgaaactgtgagtatttacatttcaatccgcccgtacggcagcgcgaagaccattactgttgggatcatgctggacaaaaatattaatgatgcaggggcataaaaatgacacagcgaattggcggtcagtcgtttgatttttcgctaggtactgaaaatatccacgttaaaaccatctcattagatgtaacggataacaccgctgcaacacaaacacgcggcattccggacggctatgttgctggagatgtggcggcggagggtgaaatggaactggacacccgcaattttaaaaaagtcagtgtggcggcgaagagcgcaggcagctacagagcgatgccggtaacggatctgttgtggtatgcgaacaccggcgatgaagagctggccgtcgaggcatttggttgcaagctgattgttaccagcccgctggcttacgatccaaaaggcggcgaaaccgcgacccacaaaattaaatttatcgtgaccagcccggattttgtccacatcgacggtgtgccaattttatctgagagtgatgttcgcgaactgattggatgagttatacatatgccaaacggagaaaccacacttatcacccggttgttattgattgcaacaatcggggccactatcgccctggggaagttattggccggcagtgagcaaatcacattacgcctggcgctcgggcgcattattttgggtaccgccgtttcattgctggccggcgcggcgctcattcacttgccagaaattggtgagctggaattgatcgctatcgcgtccgggctgggaattgcggggcataccgccgttgagttgatattaaaacgctatctgggcgggcataaaaaaggaaatgaattatgacgttaagcgaaaaacaacagctatttgctcagttgatcgcgcagttgattgtgtgggctggcgacaacggatatcgcttgacgtttggcgaagcttaccgcaccccagcccaggcggcactcaacgccagggcgggaaccggcattcgtaacagtctgcatacccagcgcctggccgtggattttaatctgtttactaacggcgtgtatcagacaaaaacagaggcctatgccccgctgggtgagtactgggaaaaactgggcggcacctggggcgggcgctttaaatccaatccggatggcaatcactttagtcttgagcatcaaggagttaagtaatgagtcgtgagctgttgcttattgcattattactcgccgtgggcgggtatatcggctgggcaatgcgcgacggcagtcagtcaacaacggaactggcgatgagtcaagtcgctgaagctaatcgtgttcagcttgaaaatatcgctcagatatcagcgcggcagttagaggacaaattatcggagcttaaagcaaatgaagtgcatacagagcgaattatcaggactgagatcatcaagccggtatttagcaatatttgcgctactgatgagtatgtccggctgttcaacgccagttcgacccgtgctgaacgtactttatcagcaaaatttgctgaccccgtgcccggagatattgccgcgactgagcggtaataccggcgctgattttagcgatacgttagaccgatataaaacgatatacaccgagtgtgccgcacggcataaccaattgatttttgaaataaaacaacgacaggaattaacaaaatgacgacgcaaaataaaaatgtgatcacactgaccatcaacggtaacgcggtgcagtttgcaccgacactggtcgcttataacaaatcactgaatgaagcagcgcgtgacgaagatgtggtcggcgctatcagtacttatctgaaacgcattgttgtacccgagtcccgcgacgcgctggcagaactgcttaagcgtccaggcgtgggggcgcaaatcatgaaaaaagtgaatgagatttacgcgccggcggcggaaattgaagtaaaggaataggcgcgttagtcagcgccataaaaaataatcagttagaacaatatatgacgctgagacgctactacctgccctctcctcgcgacagcgaggaggaggagggagagccggacagtgtcatgaatttggcccgtgcggcgtggctggctgagtatttttacgaaagtcacgttaatggcacggcggcggggatcagctacgcctttaacggcaaacgggatcaataaaatgagagaattggcttttctgctgagtcttaaaaacaacctgagtgccccgcttggccgggcgcaacagtctgtagagcagtttgccaaaaaatcccaggccgcatttaaacagattgccgtcggggccgtcggactgtggggcgtggggctggcagtaaaaagcctgcttaacccggcgcacgaagtgcagtccgcgcttgatgagctgtcaactcgcaatgtaagcactaaagcattagatgatgtctacaaatcagcacagcgattcagtacggcatacggcaagtctgccgccgattttatcgcgtctacaaccgtcattaaaagccagctttcatctttagctgacgctgaattaccccgctacgccgtggctgtcaataccctagctgtcgcgacgaaaagcagtgcagagcaaagcgctggctatatgtctgcgatggcaaatttgtttagcagcacagtgaaacagatgggtaacgtgccgtttgctgaaacgctggcgtcaaaatccgcttatatgttgcagcacttcggcgcagacatgacaaaaattcaggcgatgatggcgggcagcaagggcacgggaactcaaatgggggtcggcatggatgagcaactggctgttatgggccagttgagcggcacactcggcgctggcgctggcggggcttatgatgcatttctgaagaatgcagtggccggcagtaagcaactgggcctcagttttactgacgcacagggcgaattgcttaagttcccggaaattctggacaaattacaaggcaaatttggtaacacgatagagggcaatatcaaagcccaggccgcactaaacaaggcgtttggcgcaggggcgcaggcattgacgggcgcgtgggggcaggctgataaattgcgtaaacacatgcgcgatatgggcaacacgcaaggcctggaccgtgccacggaaatggctaagaaaatggctgacatgtgggcgcgagttgatcaggtctggaagcgaattcggatttcggtgggtatgcagcttatcccggcaatttcgccgctggcaaattacgcgatcaacgccggtacccagttctcaaaatggttagatatgttccccaacattgcgcgctggatcggttatatcgccgtggcaacgctggggatggctgctgccggggccgtcgctaatattattatgggcgtgtcaaaatttatttggctcggattgctggggatttggaaagttgccaaattgtcattagtactgctgaaagtcgcccttcttgcctggaatctggttttgaacgccggcgcaatagcaatgcgggttttcggcattgcgacgatgctggccggggccgggatgcagtttttaatgagtcccgtcacgctgattatcgccgcactggccttgctggccgctggcgtctggtatgtgatttctcactgggatcagctgaaagcctcgctctttgacagcgccgcgtttcaatgggtcatggacgttgccgagaaagtcggtctcgtgttcgccggcctctggatcgtcatgcaaatgggctgggaaaaagtcgttgatttcttttctgtcttgtcgccagtcaaggcgtttagtggcttcgttgatgctatcggtaatgtattcagtggcttatgggactatctaatggaatcattcggggcaacatacaactggattgtcacaaaattaaataaaattccgggcgtaaatattgacttgaagcccataggccaaagcgaaagtggcgcagtcgcgcaagcaacgacgttacccgcgccggcgggcctggtcagtccagcaatgaataaaggcgggatagccaaaaccctgaccactaataataacaataaaaacagcatgatacgctctggtaacactatcggtgaaatcaatattattgcgccgagtggagccacgtttgacagcatcatggaatccagggagctagcggcgggatgagtgaacgactgtatatcgacttactgataacggacagtgattttacgctgtcgtccggcaatgaaccgctgttgtgcgacaaccgggtcagcatcgcgcaagactgcgtacaccggattatcgagtccggcctggtcaagttattgattgcagagcgtagcccggtattacgcacggatattttgttgcaaatggaattactgacagaaacagatgcacgtatcgtgcctggcactgtgctaattacagatgacagccagggacactattttattactgctgacacttacgattttggcccgctgtcactgagagatttattatgaataatcgccccgacccggactataaagccattcttgctgacgaggggttgcctgtcactgaaacgcagatacgcgctgagtttgcagcgattgtcgcggatgaaaatttagtgactaacacgtcacaaatgtcgccgttctggcgtttgatcactgctcttgtcatcgcccccgcgatgtggctggtcaatatcctgacgggcgcagtcattgcaaatatgtttcttgcgacagccagcggcacgtttattgatttgtttgcctgggcagttaacttatcacgcaaagaagccagcaccgcgcagggcgtgatccgttttactaaaaatacggtcagcgcagtaatcacagtacccgccggaacggtcattcaaactgagcgtatcaacggcactatctacaaattaatgacggtggacgatgccgttatcgctgccggggtcattagtgcgttagtttctgtcaatgccgagtccgccggtagcggccacaatctggctcccggctattttcggatcatgcccgtcgccgtcagcggtatcgccagcgcagtgaatgaagacgactggttaattgcgccgggcgcagataaagagcgggataacgacttgcgtgaccgggtcagaaatcagtttaatttgccaggccaatatcacattgatgccgtttaccgcggactgattgccggcattgccggtctgaccactgaccggatatttttcttgcacgatgccccgcgcggccctggcactgccaacgtctacttgttgttggattccggcattgcgagtcagccgtttatcgacacagtgaatgactatgtcatgacgcagggcaatcacggccacggcgacgatgtgttgtgtctgccgctgccggaggtgatttatgaccttgttgtgacgttacatctcttcgagagcagcaacttagatgacgagcaaaccgacgcattgttggcaaatatccgcaacgtgatcggctgtgcatttcgcgaaaacacagattatgaggtacaaaaaacctggccttatagccgatattctttctctcgtctggctgaagaattacatgcgaattttgctgaaattgagtcactgacattttcccagggcgacattgtcagtgggctatctgtcccccgcctgggcgtactaacactggagaaagcgaatggataagttgccgaaaatcacattgccggcgtggatgaacaagggcgaacccgtcaagttaatgcgcgcttgcctggcattttggcaaaaagtttacacctggttaaagtggccgcttaatcaaaccgatccgcttctttgcgttgtgccgctgctcaatgttcttgcgtatcagcgcgatgtcgcgcggttccccgatgagccgctgtcactgtttcgtaagcgagtaaattacgcgtttattaacgccagggatgccggctcgctggcggggtttgcggcaatatttgagcgcctcggcatcggcgttattacgcaacatgagcgacagccaggttacgactgggacattattttaattcgcgttaatgatgttcaactttcagaaaataataatttaatgatggcattagttcggcaatatgggcgcacatgccgccgttatatatttcaggttgtcaacgctacgacattgaatatacacggtggaatgtttggcggtgattattattatcatcatgcacaattaaatattgtaccgggtctgatgccaggaaacattatgttaacgcctgcacaaatgcagcacacacacgcagtatattcggcaaaattagattaaggattatttatggctacggtaattacccgtgcttttgaaaactggcaggcgcaacaaacattaaataacttacctgcccgtccggacactgttatttttgcgcatattcctgaacttgacagcagtactgagattgatcgcaatgagggcattcctgctaatgagttgattgttcatcagactgacgttgcacaatttggcgtcattaatgattccgctgttgcgtattctgttgtacttgataccagcgtcggggatttttattttaactggattggcttagttgattcagcaagtaatacattgtgcatgattgtgacttttcctgtgcagcaaaaaacagcgacaaacggtagcgttcagggcaacaacatcacccgtactttcaccatggagttcaacggtgcggcggaagtcagtcagataaatgttaccgcgcaaacctggcaaatagattttagtgcgcgcctcggcggcattgatgaaattacgcgcctggctaattatgattattacggtcatgcggcttttgcgtcaaacggttataccctcgtcagggagggtgataaatatcgcgttggtgcgggtctggcttatattggcgggatccgtgcattaatgacagacgacatgttaattgatgctggcgataaaaatttaatttatatcgacgtcagtttgcaaggtagtgttttgagcgcatttaaagccattatttatattggtgctaaaaacagtattgatgatttaaataattacactgacccaaacggatttattcattaccttgcgccgctcgctttgattaccgattccggaatagaagataagcgtgacgcgggtccgtttgataatgatgacgtgataaatagcgttaatgatgctattgcgctacacgaaaagtcccgtaaccatccggacgcgacgttaacagataaggggtttgttaagttaagcagcgaaattttcggccaaagcgaaagcgaagcggctacgccaaaggcagtgaatctatcgatagctctttttattcaatctatgactgatcacgtcaatgccgctgatccccataaaaaatatttgctgataaaaaatcttttatcagcaatcgttgaaatggggccagaaggcgcagcaacactgattacgtatctcagtcttggaaatgcatcacaattaaatgtgggcacgactccaggcacggtggcggcgggtgatgatgtgcgcattgttaacgcgatacagtcaacaaatccggatatcaaactccccggttcgttgaatgttgcagggggctttttggccgactctgttaactcaagtaataatattacggttggcggcggtgcagccacattactgtggaacggtgatgttcagggcgcagtgtggggcggtgactatttatcaaattatgtcaataaaataaacgcatatggcgtggttgcgctggcgcgcggggccgaagtgggggtggggcaaagtagctccccggccggtacttttataacacgtgctgttgtcaatccagcgagttcatatgcgcgcggtctatttatgcagcgatcaacgggtcagtgggttcagatgggaggagatatttaatggcgacactgcaacattataaaaattttgaaatatcagcgcagcaatatgatccggaattgcaggctgaagtgatttatcacgttgatgaagatggtagggattggtacgcactgcaaaaaacatttagcgaagacacaataaaagtgggctataacgcgcaagggtttgtttgcacagtgtcagagcatgtttacgcgattgcgccaacaggcttatctattgttgaagtcaattcattgccagcgggtttttcgttggtgtttggcgcttacgagtaccttaacggcgctgtagtgatgcgcattccgtcagttgatgatctcacagcagcggcggaagagcgtcggcgcgagttgatgagtaatgtgtctgttgagatagcaacacttgatgatattgcgcaaagcggcacgggtacagagcaagaacttaagcgactgactgcattaaaacagtatcgtattgcattgatgcgacttgatattaatgagcagtggccggtgttgccggcgtgacgtggcataaatcgacgttacgcattccgaaaaatctggccccggtcagctgctcgaccgtggccgttcatccttggacgtttggcgtaggccagacagagaaatcaggttcgtttctgagtccggataatgcaattaacgcactcgccagccgattaactggcgcagacagtgatcaggatgtgctgatattgcttattactgcgaaaaccctggctgaatttattacgttgttgaccgccgctgctgaagtgttcccgataccgtcgctaacgcaagttcagcgacgggctaaggcggcgttaagtctcgatagcagtaaaatgcaaatcccggcaaagcccggcggcttgcccgccagtgcgccgctgtcagttgcgactacgcgccaggcgtccggggcgcaagccttgcaaaaagcgatcagtgataccgccgccggcagcagtagcgcggctatcggtgccgcgctggctgcattcgcacagcaacgcgctgcactgttggcgggggcggcaagtagcttggggcaattgcagggggcgagtgtgccggtctggtcactttcagtggagggcaacacacaaacggcgatcactactatgaaaaaagacattccggacggccaggccatttttagcctggcgttactgtttgtgggcgcagatttggccccactgcgtgctatggtggtaaatcatgactgatattgtgatgttggcgcttgacggcgaagctattccgctaaaaaacatcattgtgacgctctctatgtcaatacaagacaaggaccaaagcggacaggccagcagcacggccagcgcggagcaaggcacaaaaggtaaagagttaaaggtgtccggggtagtcgcttatagcgataaatcgatattgacccgtattttcagtcttgctgaagcgaaaaacagtgacggcagtaaaaaacgctatcgcgtggcacatgaaatggcgcaagcagtaaagtttcgggaagccacatttagcagcggcgtggatgcagcgcaacagacagacagcatggcctggctggttaattttacgctgactgaacatgcaagcgttgctgagcgtaaagcacaacaagcgagcgcgggcggtaaaactacgacaatccagacagcagatggcaccgccggcgcggcagacggtgaaacagcagaaacccgcacgtggtttgaaagtgtgctgcaaaaggtcgataacgctatcggccccgccgggggtgaagcatgaaatccgttgtcacgctgagagtcggtgatgatgtgattgctgcaaataaattaaatctttcactttcgttaaacggctgtgggatggggtttgttacagcaataacggatcgggactgtactggcgagctggtgcgtctggatttgggttataacacatcaatatatcgctggctgacgggatttgttgaacgtagcgcgccagctgaaaatggcgcacaacgattaatggtgcgcgagctggtcggcgtgttcgagcgttcgtgtccgtgctcactgcaacaccctacattacgcgacgtcaccgaggctatcggcgcggcaacgaatatgcggtttgtcttgcccgccggcacggcttatacagacaccccgatcccccattttcaacacaatggcagtggttatctgcttttaaaggatttgggccgcgcgttcagtattccggattattgctggtaccaactgccagatggcacggtttatgtcggcagttatgcagactcccgatttgcattgacgccagtcgatatcccgccggaattcgcccagggcggcagcagcggtaatagcctggaattgccgcttatccctgccattcgtcccggcgtgattgttaatggccggcgaatcactagagttgatgtaagtcatgacacgatgaccttgatctggacgccgctcgacagccagggccagccggcacagaaaacagcagagcagcgccagattgataaaatttacccagagctgggcgcaggcttacatttgccccgccgcgcgcgggtgatgagtccgaccgataccgccgagttgggtgacccgtccgatcccttccggccacgttatgccgtcaatgttcaattgctggatgagaacggcaacgccgccgccggcgcgcaggaatataacgcggtaccgctccccattccgatggctggcggtgaggggggtatgttccagttcccacctgaggggacactggtcgaaattggttttgctgatggccggccagataagccgatgattaggcaaacgctgtctgaagggctatcactgcccgccgtcaagccaggcgagcagttgcagcaacagcgcgccggcgtcagtcagcgcgtgacggtagacggcagttggcagcgtgataccgatcaggcgatcgaggaaaccagtagccggcgcagcgtgaccagcgacgaggaaaaccgcactaccacaacccgcagtaccacgataaaagccaatgacagcactacagttttggggactaaaacactcatggccggccaggtggtgcaacttgccgagggtgactactcaatcgggacatcggccaatatgttgaccaaggtcggcaaagacagaactgacgatgttggccagagccaaaatatcacagttggccataaccaaaatgtcatggttggccaggaccagactactgatatcggcggggcgctcactgagaaaatagcgggcatccgtcgcagtgttgccgccgcgcaagaactgatcgccccgtcagttcggttgggtactgatgaagttaacgtgttgacgctgctcactgatacgcttgatgtcatacaaacgctggcacagcagaccgccagccatacccataccaacaccggcggtccgcttaacgcgggtgattttactgccacagcaaatcgcgcatcatctctcgctgtcaagtacggcccgttcatcgcttaaccactcgactgcagcacagacgtaaatgtctgtgctcgacacccacaataaaaccttctgtagcacacgtagcgtaggcgctcatctaagcagtggggtaacccgcccctcaattcgatctcttcactcgcaagcaccggcgaatcagaaacccacgtacggaatcaatcgcgagacgtaaacggcgctacaccgcacccgcctgcacggtttggatcataaaaattttgcaaaaattttgaggggcaaacaaacccgccagaccgcgccgccgctgggctgttgctgtttgaatggttttgcactcgccgccaacttttgcagtagtttgcaaaaaatagcggatatatatttgataacccgttggttaacttcatgttttaaaaggatctcttttggattacgtgacgatcaaataaaagtggcgaggttattttcatgtgaattgaaagtatggtgaggccatatgccgcaaggcttgcgggggagttgtgggttaaaaagtttttgcaataacgtgcgcataaagatctagcgtggatcgttgtttgtgatgcaaaacaaagccccgcaagcggggccatgtttactcagtgtggtcaatgtgtggacactacttgaaattaatcctttaatttcaagttgttagtttaaatataaacgcgtcgtgagatgcctttaaaaagtttggataactatttcagccagatagcaaatatccctcccctatgcccgtttcccaaatctgccatgaatcacattctcgccattttccagactatccatatagtcggcataccattgcagcatttctctgcgaccatccagatattgagcgtgattataagtaccgcgaatactgtttttatcgacatgagccagttgtgtttctatccaggccgtattgaaaccttgctcatgcaaaatagtgctcattgtgtggcgaaaaccatgtccagtggctctgccgccataaccgatacgtcggattagtacattgagtgtcatctcactgataggcttgctgtgctgtattctgccagggaacacaaactgatagcgcccgctgataggttgaatctgctttagtatcgtaatggcttgatccggaagcggcaccatatgtggccgacgcatcttcattcgcaccgcggggatctcccataaggcattatcaaaatcaaactctgcccattcggcctgccgcaattcacctgggcgggtaccggtgaggatcaacaaccgcatagccaacttaaccaacatgctgccgctataactggcaaggctggaaagaaattcagggatttcattaatcgtaagatgtggatagtgttcgcgtttatgaggagcaaaagcactggcaaggtcaggggcgggattatattcggctcggcctgtgatgatggcgtatttccaaacctcaccacatcgctgccgaaccttacgcattttctcagtggcaccccgtttttctaacttggacagcacggccatcagctcaagcggtttaatttctttgattggccggtaaccgatatatggaaaaacgtcactttcaaacgtgctcatcatttctaaacgataagattcagaccacctatcgtaacgccgttgataccactctcgggtgatagcttcaaaggtattcgtcgcttcaccttgtcgggctagtttttcctgttgtttgttctggctgggatcaccgccaccagcgacaatcttcttagcctcgtcacgttttactctggcaaccgctaacgacacgtctggatacacccccacggccaacaacttctctttccccgcaaagcggtactttaaacgccaataacgcgagccattggtattgaccaataagtacaaaccgcccccatccgcgagcttataggctttgtctttgggtttggctgtttcaacctgccgggcgtttagcttcatctgggggtaccctttaagtgggtataatttgatacccccatatataccccccgctataaatagatttcaatagacgaacatgtatataggaataactagattagcctgagaagtgcagatttactgggtttgatggacttcgggagatactgagagacgttaagttggagcgggtgaagggaatcgaaccctcgtatagagcttgggaagctctcgttctaccattgaactacacccgcgtcggtgtgcggctagcattataaccggttctgccctatgggcaagcgaagatatgctctaagcgccggtattttaagcgattagattaaacaatacatcactaacaccgttttacttcaagaaacaagtttagctgactcagtaaaaagggcgccgtagcgccctgaggaatttatcgttaaaccgtgtcgcttattttaccgggcgcatcgctgggaataaaatgacatcacggatggtatggctattggtaaacaacataaccatacggtcaataccaatacctagccctgcggttggtggtaagccatgttccaatgcagtgatatagtcttcatcgtagaacatcgcttcatcatcgccagcttctttagcacttacctgatcggcgaaacgctgcgcctggtcttcggcatcgttcaactcagagaagccattaccaatttcacggccaccgatgaagaattcaaagcggtcagtgataaatggattatcgtcattacggcgtgctagcggagaaacctcggctggatattctgtgatgaacgttggctggataagatgactttctgcggtctcttcaaagatttcacattgaatacgacccaggccccagctcttctcaaccttgatacccaatgattcggcaattgcgacggctttatccatatcgtctaaatccgcgacattggtttcaggacgatatttacaaatagcttctttcatggtcaatttggcaaaaggcttaccgaaatcaaaagtctgttcgccatattgcaccacactgctccccaatatggtttcggtcagagtgcggaatagctcttccgtcaagacgatcaggtctttatagtccgcataagccatatagagttccatcatggtgaactctgggttatgacgtggcgaaaccccttcgttgcggaagttacggttgatttcgaacacacgttcgaagccccccacgaccagacgtttcagatacagctctggcgcgatacgcaaatacatatcgatatccaacgcattgtgatgcgtgacaaacggacgtgcggaagcgccgccagggatcacttgcatcattggcgtttcgacttccatgaagcctttttcaaccatgaagctacggataccggacatcacttgcgaacggactttgaaagtatgacgagactcgtcgttagcaatcagatccaaataacgctggcggtaacgggtttcctggtcagctaagccatggaatttatctggcaatggacgcagagccttggtcaacagacgcagttcgctacagtggatcgacagctcaccggttttggttttaaacagtttaccgcgcgcacccaggatatcgcccaggtcccactttttgaattcttcgttataaacgccttccggtaggtcatcacgggaaacgtacaactggatacggccaccaacatcttgcagagtcacaaatgatgctttacccatgatacggcgggtcatcatacggccagcaacggttacgtcgatattcagtgcttctaactcttcattctctttactgtcaaactcggcatgcaactggtcggaaaggttctcacggcggaaatcattagggaatgcaattccctttccccgtaagacagccagtttttctcgacgggcttgtaactcactattgagttcttgcgcttgctcagcgacttgtggtttttgctctgacatctcagttcctcatagcccggctttcaagcttgcttcaataaatttgtccagatcgccatccagtacagcttgcgtgttgcgtgtttccacaccggtacgcaaatctttaatacgggagtcatccaatacataagaacggatctggctaccccagccgatatcggacttattgtcttccaaaacctgtttatcagcatttttcttttgcatctcaaactcatacagcttagctttcagctgtttcatcgcttgatctttgtttttatgctgcgaacggtcattctggcattgagtcacgatattggttggaatatgagtaattcgcaccgcagattctgttttgttgacgtgctgaccacccgcaccggatgcacggtaaacgtcaatacgcaggtctgccgggttaatttcaatatcaatatcgtcatcaacttctggatagacaaaggctgaactgaaagaggtatggcggcgaccgcccgaatcaaatgggcttttacgtaccagacggtgtacgccagtttcagtacgtaaccaaccgaaggcatattcaccaattattttgacggtggcagattttaaaccagcaacatcaccgtcagattcttcgatgatctcagttttaaagcctctagactcagcccagcgcaagtacatacgcagtaacatactggcccagtcctgagcttcagtgccaccagaacctgcttgtaagtccagatagcagttggcgcgatcatattcgccagagaacatacgacggaattcgagctggcccagcttgccatcaagaacctctaactcagcaattgtttcgttaaaggtttcttcatcatcagcttcaacggctaattccagcaggccggacacgtcttccaagccttgctctaattgatcaatggtggtgacaatctcttccagcgtagaacgctctttgcccaacgcttgagcgcgttcgggttcattccagacgtcgggctgttccagctcggcgtttacttcttccagtcgctctttcttggcatcatagtcaaagataccccctgagaacggctgtccgatcagacaggtcctgaattcggttttttaccgggtttatttcaaacatgatttaaagtcttacgttgtgtcgtagatgacggaatgtcatgagaaccgataattctaacggatctgtacgacagtttatagcaggttgattatatttgtagcgccatccccttcttccttggcgttgcaacggtgttagccgcgcaaggaagaaggctgagtaatcggctaacgcgctaataaggccacaagtgttgaaccagcaactgaacactgcgattaccacgatattcattaatatccagtttataggccaatttaacttctcgcacgctgctatccggccacaaagtggtatcgacattaaaggcaattccatctaacaaaggcccgccattcagcggctctaccatgagtttcaggtgacgctcacccactaagcgctgctgtaagatacggaatttgccatcaaaggtcggctcagggaaagattgcccccatggaccaccgtcgcgcaatagctctgcggtctccagtgataactcagcaccgttcagttcgccatcagaccaaataacgccttccaattgcgaagcatccatccattcaccgactaaatctgcaaaacgctggcggaattcatcgaatttaccttcctccagcgataaccctgccgccatggcgtgcccaccaaacttcagtattaaccctgggttcagagtgtccagacgctcaagggcatcacgcatatgcaaacccgcaacgctacgacccgaccctttcaataacccttctcccgccggggcaaaagcgataaccgggcggtgaaagcgttctttgatgcgtgaagccaaaatacccacaacgccctgatgccattctggatggtacatcgcgataccgtaaggtaattcactgctggtgcgctccaactggtcacacagttgcaaagcttcaacctgcataccctgttctatctcgcgccgggtttgattcaaggtgtcaagatcgattgccagtgctcgcgcctgagcaatatcgtcactcagcagtagcgccaccccgatggacatatcatctaaacgccccgccgcattcaaccgtgggccaagagaaaagcctaaatcgttcgcaaccagttgacgcgcatcacggttagcgacctccaataatgcgcgaattcctggacggcacttccccgcacgaatacgacttaacccttgatggaccaaaatacggttattggcatccaacggcaccacatctgccaccgtacccaatgccaccaaatccaacagttcagccagattaggaaccgctaaggtacgttgttcaaaccaaccacattccctgagacgggcgcgcagcgccagcatcaaatagaaagtgacaccgacccccgccaatgacttggataaaaaatcgcaaccggccagatttgggttaatgatggcatccgccgcgggtaatgtttcgcccggcaaatggtggtccgtcaccagaacctgaatacctttggcatgagccagatcgaccccggcatgagaggaaataccgttatccacagtaacaatcagctctgcccctctggccgcaacttgttcaaccacttcggggctaagcccataaccatcttcaaatcggttaggtaccagataatcaaggttactgccgcccatactgcgcaaagccagcaccgccaacgcggtactggtcgcgccgtcagcatcaaaatcgccgacaatgacaatacgccgccgatcagccagggcttgttgtaataaggtgacgccagcgtcaataccatccagtttttgccatgccagtaggcctttcacgcccctctccaactcctgcgcatcctttacgccacggctagcatagagacgacgcagtaacgggggcaattgcgcaggtaaatggctgtcatctgccgcctcacggcggcgaagttgggttttcaacgtcacaggtaatcaaccacccgcttttagtgaagcctgatgcgcattaagcatctgtagcatttctttcggtccctgatagcctgggacaatagtgccattttgcagcacaatagctggcgtaccctggataccaaattgcacacctagctgataatgcttgctgatatcggttttgcaggttgctggggagatatcattatttttcatggcatcatcaaaggctttattacgatcagccatacaccagatagaacgcatgtctttttccgcctgagagcttaacccctgacgcgggaaggccagatagcgaacagtgatgccaagcgcattataatctttcatttgttcgtgcaatttacggcagtagccgcaggtaatgtctgtgaacaccgtaatgacgtgtttttcctcgggtgctttatacacaatcatttcactgctcaatgcttccagttttttcagcaacgcctgattggtcacattgatgggctgatcgccactcacgtcatacagcggcccttgcagcagatgtttaccatctgctgagatatagagcacgccgctttcggtcatcaccgtactaatgcctgggataggtgacggctggatatcagcttgttggatatctaatttttttaaggtttgctgaatagcagaatcatctgcattagcaacccccgataatgcagccattaacattggcagcagcaataaactttttttcatttataaatcctatctttttccatacagcgattaagcgcgtggatgatgctgttgatgtagctgtctcaaacgttcagtcgctacatgcgtataaatctgagttgtcgacagatcactgtggcccagtaacatttgcactacacgtaaatcggcaccgtgattcagcagatgcgtggcaaaggcatggcgtagcacatggggtgaaagccgttcactatcaataccggcaaggatcgcatagtgtttgatgcgatgccagaaagtctgacgggtcatttgctggctacggttactggggaacaatacatccagcgatgcgccattaaccaaccaaggccggccatgctccatatagttctcaatccaatacacagcttcttcccccaaggggaccaagcgctctttattccctttaccaatcactctcaccacaccttggcgtagactaacatcactgatggtcagcccgaccaattctgacacccgcaagccggtggcatagagcacttccagcattgctttatcgcgcagttccaagggaatgtccacattgggcgagttaagtaacgcatcgacctgtgcctcacttaaatccttcggcaagcgctgcggtaatttgggtgaagagagcagcgcagtcggatcatcctcacgcagtttctcccggtataaatattgaaataaccggcgcatcgcactgagtaaacgagccgagctggtggctttatagccaccctcgatccgttcagcaaggaaggattgcaagtcctgcgggctggcgcgcaataaatcactgttatggtgtgtcaaccatccaaccagcgcatgtaaatccaaacggtatgacgccagtgtattctctgccagatttcgttccagccacagagcatcaagaaattgttcaatcagcgggttatcttgctgtttcattgctgtctctctctttgattgaactcagtcaccattatgcctgatgacagggcaaatctggtacactcgatgctattccttattagcaatgctacggctatacatcatgaagattggtctcttttacggctccagcacctgctataccgaaatggtggcagaaaaaatccgtgatatcctcggtgaagatctggttgatttacataacctaaaagaggttagcccccgcctgatggaagagtattccattctgattctaggtatacccacctgggatttcggtgaattacaggaagactgggaagcgatttggccgcagttaacacaactcaatctcaagggaaaaattgtcgctatgtatggcatgggcgatcaatttggttatagcgaatggttccttgatgcccttggcatgttgcacgaccatattgcgccgctgggtgtgaaatttatcggtttttggccaacagatgggtttgagtttactagcccaaaaccactcagtgccaatggtaaacagtttgtggggttggcgttagacgaggtcaatcaatacgatttaagcgaggaacgtattgagcagtggtgtgagcaaatcttgttggagatggaggcgttactttgatcctccgggtcagaacctgttacatcagagctcaatttaacgggcacccgatatgcccgttaagtttagtctagctgcgcccggttacttccataaacggaactcatctttctcattagcgtctttttttacgtgatcatctttttttttattatcatctttcatactctcgccctctggtgccgttttgctcgggctctcttcagcgcttggctctggagctctccactcggtcaaccgttgtgtatcagcaacttggtaccagtctaaacgccgcgtcaataacattaccaccgtcaagacaacaaacagtaacccagcccctaacagcagtgcgttgtcctctgattgtaacaatccgtacaagatgccgtacaacaataataagccgcaggcaaacaatgtgccgcgcaaccatccgcccaatacggcactcaaatagatagcaatcaataagctacagctcagactggccagaaggtaagccagtgtgaaaccaatgtgttcagagaacgctaacaacatcagatagaacagaaccaatgccgccccgactaacagatattgcattgggtgcaggcgcaatgacgtcagactctcgaataggaagaagctgaagaatgtcagaccgataaataaaatagcgtatttaatggctctttcggttaattggtagtgatcaaccggttcaatcaggctggtggtgaaggccggtaagctaccaaaatgaaaggctgcatcgccaccggtgaaattcgtgttcatgctgttggccaaccaattactgctccagtgagcacggaagcctttctcatcaaccttgcgctgcaaaggtaaaaaattaccgacaaaattaggatgtggccagttactttgtaacgttaattcactgttacgcccaaccgggactaccgataagctagtcgtacccgcaagcgacatggtgaaatcgacatcaaatttaccctgtagaacctgctctattgtcaatggtgcatgaacaccttgtaccgagtgaccggagaaagcgccgggttcgaagttaattttcgtcttccctacgctgagtggcgaaatgcgctggataccccgcgcatcactcagtgccagcaccagtgaaggcttaccaatgatgacgccttcacgatctaaatcatccagcgaagatacctcaaattccccatggaaatcgaattcaccctgatatacctgtgttttataaatacctaactggcgaacttcaacatctggggtcccttttacagtcatcacgtttggcagtatgtagtgataaaagtgggtccatttcccttgcttcttgccatcgacttcagtttcaacccactctctatacggcacgacaatcaatggaccgaggattttttgtgaacggctggtactgtcactgactttatcgatcacactttgtcggtagccactgcgttcatcgattacatgcagcagcatccctttggggatcatcatcaatagcattaatcccagcagcgtaactattttccaaaacaacacagatttgaacatgacttgcactccttttaacatgaattgcactccttttaacatcaggagagcagtttacgaccatgaagtgaaaggtgaatgaggctatgtgaagtgaacgtgaagttggcgataaaccctctacagcggtaatgtcaaacgcgcgctaaccccttgcggcaggcggttctccaaacaaatacttccttggtgaatagcagcaacttcacgtacaaaatttagccctaaccctgtacttttgacgctattagcccgtggtaacgaataaaagcggtcaaaaatcttctcttgggcataaccaggaataccactgccactgtcttcaaccgtgatcagataggtatcatcttgccgttcgccactcacgctaatttctcctcccgcgggcgtaaaatccagagcattatcaatcagattgtttaaggcctggctgagcaacagcccatcgccgatcaacatcgcgttatctacagattttagccgcagagtgacccctcggctaaccgcctgagcttctttggcgctaaagctctgcttgagtatatggctgatttccaagggggagagttgtagatctacccggctctccagccgtgcttgcaccagcattttatctaccagttgctggattcgtgcactttgctgctcaatattgatcagaaaacgttgtgcggtctctggcggtggagactctcgcagtaactcagccgccccggagatagcggccagcgggcttttcaattcatgagtcagcgtgtgaacatattgttcgatataggctttgccatccaatttgagacgcatgctttccagcgccagtgccaaatcattcaattcactgctccccatcgctggcagagccaccgcctgcccctcggcaacccgttctgcgtagtccaccaacttgccgatcgcccggttaatccaccacacaaaccccaacccaatcagcaatgcaatgcctaacagcagcccacctgcaaacaggatcttgcgttcactgcgtttgatcaccggcaccatggagagattcggcttacctatactcagtacaccaacaatacgattttcgacgatgaccggtgccgccacatacattaccgaactttctgcatcgtcggggtcagtgcggctactgcgggcgccatactcaccacgtagcgtcaaccagacatcattccaacgtgaatagtcttgccctaatgctcggcctgatgaatcaaaaatcacctgcccatcagtatcggtcagatagaccctatattcattgcgatccttacggataccttcaatattggcaccaataggccgcagattaagggaagaaaatgcttgcgccaattgcccgtcggccactttgttctgcaatatatcctgccgggcgaattgcgccagtaaggtcgccgtatccactaaggtgccttcagtcgcgcgccgcactccgggtttgacttcctgcaaaaaaatacgaataacaaagtagccagcgatagccacaatcaggaaatagccaagtagcaaccgtacaccaatcttcatttatagcggctcatggctgataacccaggctatagcccaatccacgatgtgtgcgaatgggtgagtcttcagcgtaaaccgtgcgtaattttgatcgtagcgttttgatgtgagtatcgaccgtgcgatcttggctttcttccgcctgcgcccagacaatatccattaattgttgacgtgaaaatatgcgttcaggtgccagtaacaaggttttcaacagcagatattcatagcgggttaaccctaaaatctgttgatgataggtcactctggcaccggcttcatccagcgaaaaatgaccgaattgatatgatgtggaggtaaccgccaataagtgtgatttttgtaatcttcgcaatatggtacggactcgggcacttacctcacggggggagaacggtttggcaatataatcgtcagcaccaatttccagccccacaattcggtccaactcttcgctacgggctgtcaggaagatcacgggcagatcgggggctgccgccagcatccggcgacacagatcaaagccattaatatcaggcaaaccaacatccactatcgccaaagcgggagaaccgctgctaagtgcggcaagggcaggctccccccgatcaaaccaccggagggtaaacccttcgctttccaacgtataaatcaacgtatcagcgatactcggttcatcttctaccaaccagatcagtggcttcatcacatcgttccatcgtcagattcaaatgaatgccgcagcaacaggcatagctgccgccactcatcttcagacatgctgtcagcggacagccatagacgctttcgggtcgcgtggccgcctgtttgttgtaaatgtaataataccccatagcgggtgatccacggcggcttgaccacggtccattcatgccttttccatcgcaccaggttgccaggttttagcctgatttccccctgacaggatttaatccttttctggctgcggatacactcaaacaccactaacgtcagcaataccagccatagggcggtataacccaagggccagggcgcgaccaaggttaaaatgaccaatatgccgtgtgccaataaagaaaagagttgagtatgccaggatacccgcaggttacatcgccactgggccacgggctttatttcgtgattgaatcagtttgaccatctgatatagctcgctatcctgcggctccccgtggttcatcagccagttgaataaatctgggtcatcacactcaagcaagcggataaatgcctgtttctcgttatcgctcaagctatcatattcatattcaaaaaacggcatgatggagatatcaagttcacgcataccacggcggcatgcccagtgaatacgggctttattatcaatttccatgtcctgattgactcctcaatgtaaggatattgtctgaacccagcagagattaaatgcccgattcagttagctgttagaataactcgttaatataactaacgggaatgttaccactcccgggatagggggttaaggtactaaatacactgcaagtgcatttttttaatcgcccgaaacgggctgccgcataatcggcggctattgtacctcagatacaggcgaacaatggtgaatctatggaattactgcttgcaaagctacccggctattttaccattgggcaattagctcaccgtttctcattccaggatgacatatggcctatcatactccgtttgctgcacagccaccggtcgcctcttccgggctacccttaacactgatctcactcgatgactgggcattggttaccttaacgggtgctgatcgggtcaaatatctacaaggacaagtcacggcggatatcgatgcgctatctgctgatcaacatgtactctgtgcgcactgtgatgccaaagggaaaatgtggagtaacttacggctgttttatcgtggtgaggggttggcctttatagagcggcgcagcctgctagataaccagttgagtgagttgaagaaatacgctgtattctccaaggtggtcattgcaccacagccagatgcggtactcattggggttgcaggtagccaggccaaaaccgcgctggcggaaatctttactgaattgcccagtgcagaacacccggtaacgcagatgggtaatagcacgctgttacacttctcactgcctgctgaacgttttctgttagtgacggatacagagcaggcgcagcagttggttgagaaactggctggtcgggcgcaatttaacgacagcaaacagtggctggcactggacatcgaggccggtttccccatcattgatgctgctaacagtgcacagtttattcctcaggcaacaaatattcaggcgttaaatggtatcagcttcacgaaaggctgttataccgggcaggaaatggtcgccagagcaaagtaccggggtgccaataagcgggcgctgtattggttggcaggtaatgccagccgagtacccgcagcaggtgaagatttagagtggcagctaggcgagaattggcgtcgtacgggtaccgtgctgtcagccattcaactcaatgatggcaccgtgtgggttcaggctgtgttgaataatgatctggccgcagatagcgtgttgcgggtacgtgatgatgcgctgggtacgctagccattcagcctttgccctactcactcgccgaagataaataataaagagttctactctatagagaccggttaaccggtctctatattttgttttatatcaaatagatgggtgggttattcatctaactcgccatcaggctgtaccaaataaatcagtaccagaatggtggtgacaaagaagcggaaagcattaggaacgccattccattgctttgacatccacataccaaaccattctccccctatcgacataaaaaccacctgccaggtcaggaaacccagagtcaggccgataatcgcaataccctttttccggttaaagacttttgctggcgctttcctatttatcagcaaacctatgccaccaacccagcaaaataccgctgtcagtgtttcgagcaggataatgccgatataacccagttgttgtagccacggcgagtggatcgcacgatagctaatggtggcatcagggaaaatagtgtccatctgtaagacatgatgaacaaaaacgaagttggtgttgtagtcagtcatattaccgaaaacaaccagcgtggcaaaaagcgcaatagcacacaccatcagcgctttggataaacgcataatcatcgatagagtcactcctgaacatgacacaagcacttggttggcgcgcgagtgggttcagaaacaaaacagtggcttaaccgatacccaccagcagtaaacactatttacttgatggaaattaaacactaacataaccattgtgcgattatgcggggtattgttcggcagacatccagtctgtagccttagaaaatagatggtcgtatcaaacctaatacctgcatcaaatatgtgtctgtattaaacatgtgtctgtattaaacatatagatagatcgccataaaatggcagacactgccgcctaacacaaaaccgtgccagatagcatgaccaaaacggatacgtttcgatgcatagaagatcaccccaaccgtatataacaagccccctatcgccagcagtgccaaccccccgatctcaagcttgaccgcgagctgataaatgacaatcagcgataaccaccccatggtcagataggtcaccagtgacaacacttcaaaacgatgagcaaacgccaacttaaagatcacaccgatgagtgccagcccccaaataaccgccatcaaacctctggccagaggcgaatctagccctactaataagaacggcgtataagtcccggcaatcaagatgtagatagcgcagtgatcaaatttttgcagccagagcttcgccctacgatgtggaatggcgtgatacagcgtagaggccaaaaacaacaaaatgatactgccaccgtacaaactatagctagtgagcgccttggtatcggcaccactgttcaccgcctgaaccagtagcaataccagccccacaataccgaacaccacaccgataccatggctgaggctgttcgccagctcttcagcccacgggtaagccggggttggggtggccgtttgtgcggcgggtacggatggtgttgcaaagagaggttgtgtccctgatttattcttcaatactgattatcctaaatattaattattatctcgcccggtaaacgggttatgggccattctactgtacagaaatagcgcactcagattaactgagagtgatttcagtgtacacctgtacgctaaaaaagtctgccagaggtttctactccctaacaataaaagtaactagcccgttttgatggctgccagcaaatcagcattcagggagcaacaccgctctcttgattgagaaccccttcactcttctcttcacgcttctcctctcttatgcgttttgcaagattcggttcaatatacgaaacagagaaaaaatactctttccccaatatttttccgctgccataccaaggaattctgttgaaatacaaacttaagctgtcgtacccatactcaaacaagtaaccatcattgctaatgaacttaaaaccctcatcagagtaagtaattaatttataattaaccccagcccccacggcataaagagctttgacccgttgtaaataggccgaagcaacttcactaaatactttttttatttgtaccgaatattcattcacagtgagccctggttttttttctaactcaacggcaataattgcaaaaatatcagcattagccttcgctacagccaattgagtctgaaggtattgagctaattttttaggatcaatactcaatgttttctctttgcttgccgcttcattttttttccctggtaaggcatccgcgggtttatcagtactcaccataaactcatccgacttagggatagccatgacagaactggcaatataagcagcacagccgatgacacgactggattggtcggtactgaccaacagagaaagaggatgtccctgagggggaatattgctgatatcgatatcgtatgaccgcagtgtttgagcaacctgttcctgagtacgctcacctcgggctaatgcacacacttggctcatgacacgctcttggtactgcccctgcaccgttggcactaattcagtaacagcctgttgaataagtggtaacgcaggtaatggaatccacagtgggtccgttttcgggctgtcattgagatcccccctatagcccacattacccgaaaatccctcatcatattttgtcgctagcgaaaatccgctggctggagagaatccagcgaatggcaagaaacgggagaacggtaagagactggggaacagtaataaaccagcgaatagcagcagagataagagcactaataaagaagagaagagtaatgacagtgaaaggaagaaaaatcccagggttttaaatgatgacatggcgatcctttgatgcccaagagcgagaatcgggttgtacaaaacaccctacaacccgttagtgacagcctgaatagcattcagcgttggcgtaacgcgctctttaccactgataccctacgccgacaccaatcccaaaatcaccttgagtgttagaggatgcctgtagtttgctgacccatctcccgctgtcagaaatactcgatacccctagcgacagagccgattgaccacggtaactggccgcgccgatagtggtcatgctggaacccgaagtatatggttgtgtcaagctcgccatagacattgcgctagctatccctgcactcaacacgctattttgtttcctcagatcctgcttcagctcggaataacgttggttcgtgtaagcattagtttgattggagatgctcttaagttgatcgaagttcaccgcgtcggttccctgagttgcgggggcgacgttggtgatctgccgttcattaccaacagagcctaccgaaacactgtttgcccgatcagctactgagttagcccccaaggctgcactgtttgccgctgttgctttagcacctgagccaaacgcggtactgttattgccggaagccacagaaccggcaccaccagttgctgaattggcaccggttgcggatggcttggcaagaccgctactattattcacctgaaacataccatcggtaccattctggagcccagaaacgttgttttcgacgacgacgatagaggcagcaataccatcgagttgtcgcaaattgaccgcatcggtggcctgcagcccatcggcaacattgctgaccgtccgggtttctccagtagcagtattacccactgatacggtacccgagctggtgttactcgcattggaatacttaccgatgtagttctctacgccacgcccgttatcaccagatccctgaccaatggcaacactgccgtccgcgctggcggcagcaccatcccctatcgccaccgcccctgcccccgaagccaaagcagcattacccgaagccagagaagcagccccagaggccagagaagcaggcccgatggccaccgaatgggtaccactggctaccgagtcaggctgagtcgagttggcatggaaatacttcacaccgccaccattggcgatgctggccatgctcccctcaatggtggtaacccggccacccaggctggtgatgttcgcggtattctgctgcacctgatcaccaacagcagtcaactgagcaacattgaccgcatcagaactcgccgatccagctgcgacaccggtaatcttacgattacccaatgcggtgccaatccctaactcccccaccgatgcctgcggagccgttagtgcataagcactgtaactgctctgagcgccgaccgtattgatcgaagcagcccccaacgcgatactgtttgcctggctggtcaccgcccccgcgcctaacgccagagattgcgccccttgagcctgcgctgcggaaccgatggccgtagccccggcagctatcacctgagtaccgaaacctattgcaattccccccgttgctgccgccccgacaagggcggtgttaccaatgccaacaccgttatctccactgaccactgtcgctggcccgacagcaatggtttccaggccagaggccagtgagtctgttggattcactgagttagcatggaaatagcgggttccatcttggaccagattataaagctggctaccaactaccgcatcggtagaggtagatgaaatcgtcgcaggggcaagattggtcgctttttgcccattcaagaataacccaccttgtacgtaagtattacccgtgatgtacgcaccaccgctttgaacgaccataccgtatgcagttgcggtattactggtgccgaccggtgtagcaaatgtccctgtccaaaaagtagggcctaatgttcccgataccgcagcccccgttccaccaacaaatagctgccccgcatttgtattaataatcccaatagatggagtattacaattcggactagttataggccccaccgacggcccatccataatggcataacaagactgatcatcagcattattcacataaagctgagaagttgcggtgccagggataaataaataaatcatcactatagaaatactaaacagaccacgataaaactttatgttcataaagtaattaaaacaaacaaatcttaaaaaataattaatgtcatattttatgatgttttccatgccactctccactttattttatatcacctttttacaggtgaagaatttgtaggtagtgatgtaacaacctgaagtgaatttattatcttatgctttttagccactaattctggatgattaaataaaaattcactgtgcatctattatctaaacaaaccataacattatggaatgtcggctagttggttacacccgccatacttcaagccacatatgcgttgactacgctcaacaacccgaataatttgcagtatataagacctaacctttacacttacttcgctgattttttgtctttactctagtaccttatcagccatagaatactcaacgaaatcttatgtcgataattatggcttacactaaaaataatttaattaaatgaaacaacatagaatagaacaaaaaccttattacaaataatattatttttaaaattgtttcagacacttgataaaccatttttgatagctaaaaaccaccaaaagaaccaaacaaatcgtcaatacctatttaaaagcataaaaaacaaccatgtagaccaataataaaacaatggtaaatcatttatcatggataaaactgtcgttactggacaaaaaaccgctgaagatcccaataaaataaaaccataaaaatatcaactggtgaatacgtatgataatgtaaattaaaatacaccagcacaaccactggtgattgaactaaactacagacgacatcaaggcgcagcctgttacttttaatacactaactccagcaataaaataattctaaatagaagttatcggacactaatatattgatgtaacgttacctaagttaatcaagccaactcataaattactttttaataaaaatatttaatgttatttcaattaatcatattaacaaaataaaaaaataattatatttgctactttttataattcatcatcaaggtgtttggatgctttttctataaccatgtttggccagcaatagtgcggtagcccgcccaatcccccggctaccaccagtaacaagtgcaacattcttatgtatataaacagtccatcgctattttttcactttttgccaaattaatacccccaccagcgatgaattattcatttgcaatggcggtgtgcgtaacgttaaacgatcttcttcaaattgataatgtcgaatctgctggttaccaacccagttagggaacaagcagccttcaacagtatgggtcacgatgccctgttcctcatcaatatgatagcggccaaagtaagtcagggcggtaagaaaggcatttttaatttcgctatcacggccctgtaaccagtcttccgtagtaaatttggcccggtcaccacgataaagttgtgccgccattgtgccctgtttttcataattaatacgccccaacatgttttgtcccatcgggtagtggatactgttatccggtaaaataaaatgctgagaaatcaatgaccaactgccgatgaatcgattatttatcataatgcctcctattatgattctttatatcccattaataagcatagtcattgattggagggatacaaatagtcacctgaggcgggaaggtaagacggaaagggaaaataacacggagtaggcagcaagctgaaaaataatcatttttagataacaaataattagataacaacaggcagactgctgacaaaccccgatgacgcgatcttgaacggtgaggataggcagaagagtaaagcgtccgcgccagggaaggcgcggctcgagcctacatggatgtatttacggcgtctttacgatctgcctgttctctccgtcgcgggcactttgtcaataacctcagggccgctttcacggcccttggttttgctcagatgagattactcatagtcactgattggcacacatgaacagaacaaattccgatcaccgtaaacatcatccagacgctttacggttggccagtatttattctccagtacacccgccaccgggaataccgccagttcgcggctgtatggatgtgtccactcaccaaccaattcagcctgagtatgcggggcattcaccagcgggttgtcttccaatggccattcgccttgagccactttctcgatctcggcgcgaatagccaacatcgcatcaataaagcgatctaactcaactttactttcagactcagtgggttcaaccatcaacgtacccgcaaccgggaaggacatggtcggtgcatggaaaccgaagtcgatcaagcgcttggcgatatccatttcactgatgccggtcgcttctttcaacggacggatatccaaaatacattcgtgcgccacacggccatcatggccggtatagagcaccggataagcatttttcaagcgagtagcaatatagttggcatttaagatcgcgacctgactggcttgcttcagaccatcagcccccatcatgcggatatacatccaactgatcggtaaaatagaagcactgccaaacggtgcagcagaaaccgccccttgctgcgtcgtcatgccatcaatttgcaccacgctatgaccagggacaaacggggctagatgggctttcacgccaataggccccatacctgggccaccgccgccatgtgggatacagaaagttttatgcagattgagatgcgaaacatccgcgccaatataacccggtgtggtgatcccaacttgggcgttcatgttcgcgccatccagatacacctgcccaccaaactgatgaacgatctggcaaacttcacggatagtttcttcataaaccccgtgagttgatgggtaagtcaccataatgcatgacagctcatcacccgcgtgttccgctttctgacgtaaatcgtgcagatcaatattgccttgtttatcacaggcgaccaccaccaccgacatacccgccatttgtgctgaagctgggttcgttccatgggctgaacttgggatcagacagatatggcggttcgcctgattgcggctctcatggtaacggcggatagccagtagaccggcatattcaccttgcgcccctgagtttggctgcatacagacagcatcataccccgtcagttgcactaaccattgcgatagctgaccaatcatctgctggtaacccgcagcctgttctggtggacagaatgggtgcaattcagcgaactctggccaagtgattgggatcatttcagccgcggcattcaatttcatggtgcaggatcccagcgggatcatcgcctgattcaatgccaaatctttacgctctaaacgatgcatatagcgcatcatttccgtttcgctgtggtaacgattaaacaccggatgggtcaggatcgggtcccggcgcagcatactgtcttgaattgattggctatgctgactaacggcggcatcaagttgatcgatatccaaaccgtggttatcgccaacgaacaaggcaaacagcgtctgaatatcttcgcgtgaggtggtttcattcagtgtgatccctaccgcgccatgaatgtcagtacgcaggttaatgccaaaacttaatgcacgggccagtaccgccgctttatctttaacttcaacggttagggtatcgaaccagtgtttgaaacgtagggtcaaccccgcgtgctgcaagccagcagccagaatgtcagtcatccggtgaatacggccagcaatacgctgtaagccctgtgggccatgataaaccgcatacagactggcaatattggccagtaacacctgcgaggtacagatattggaattggctttttcacggcggatatgttgttcgcgagtttgcatcgccattcgcaacgccgtattgcctgcggcatcacgggacaccccaataatccggcctggcattgaacgtttaaattcatcacggcaagcaaagaatgccgcgtgtggaccgccgtagcccataggcacaccaaaacgttgtgcggaaccaaataccacatcggcaccctgtgcacccggagcggtcaacagtaccaacgccataatatcagcggcaacactggtaataattttacgttttttcagttcggccaacagggcgctgtaatcatgtaactcgccggtggtcccgacttgttgcaacagcacaccaaagataccgtccagttccagtactttttctgcgcgatcaacaatcacgtcaaaaccaaaggtctcagcgcgggtcaataccacatccagcgtttgcgggtggacatcgtcagcaacaaagaaacggttagcgtctttcagcttactggcacgtttcgccagtgccatggattctgccgctgccgtggcttcatccagcaaagaggccgatgccagatccaagcccgtcaagtcttgtgtcaattgctggaaattcaacagtgcctcaaggcggccttgagaaacttctggttgataaggggtatacgcggtgtaccagccggggttttccagcatattacgcaggatgacgggcggggtcagtaccgggctgtagcccatgccgatataggatttatagcattgattctggctggcgatccctttgagttccgccagcgcctggtgttcggtggcggcctcacccactggtggtgggccaggcaattggatatctgccggaacaatttgctggatcaacgtacttaacgaactggcaccaacggcggccaacatctgctgctgctgttcaactgaggagccaatatggcgctgaataaaagcatcgttatgttcaagctggctgagattctgagtcatttgctacaaattcctgaatagcgcggggacgggaaatgggctgacacaacttatacccttcggacttgacgctacagggcgttaacgacatacactcacctgaatcagtgacctatattggataggctcatcggggacgttcgcttgcaccgggctgtagcgccatttaacctactcggcgtcagggccaataaaatggccctcacttgagttactcttcaatcgccgcgaggtaagcatcagcatccaacagattgtccagttcggactcatcagcggctttaatactgaacaaccaaccatcggtataaggcgcgctgttaaccaattctggcgagttttccaactcagtattaactgcaacgatttcaccgctgataggcgcgtaaatatcggaagcggctttcaccgattcggcaaccgcacaatcgctaccggccgaaacatcgctgcccacctctggcagatcgacgaataccatatcacccagcagctcttgcgcatgttcagtgatcccgacgctatacacaccatcgccgtcagcacgaacccattcatgagataaggcatatttcaattctgttggtacattactcattgctattccttaaaagagatagagccaaaagagaaggctcttataattcagaataatggaaaacaaacttacaatacgatggctttgcccgctcgcacaaaaccgggttttgttacccgtaccggcatttcacggttacggatttgtaccacagcatgttcaccgatacctgcgggtacacgggctagcgcaatactgaaacccagtgttggcgaaaatgaaccgctggttatcaccccaacatgctgattgcctgcggcatcaaaaaaatacactggcaattcattacgtaacacacctttttccgtcatgatcagaccaaccaattgctcagtccccttcattcgctgcctttccaacgcagcacgaccaataaactgacgatcctctggttgccaggccactgtccaccccatattagcggctaacggagacgttttttcatccatttcctgaccatataagttcatccccgcttctaagcgcagcgtatcacgcgcaccaagacctgcgggcttcacaccggcggccaatagttgctgccagaacgcaacaacctgctgtttcggcaacgcaatttcatacccggcttcaccggtataacccgtggtagcaataaataaatcgccggtttgaataccaaagaatggcttcatgcccgcaatagcctgttgctgctcggtggtcagtaacgtggcaactttttgttgggcttgtgggccttgtactgcaatcagtgccagatcgtcacgcaccgtgacctcgacctgataaggttcagcatgctgacttatccaagcgaggtctttatcacgggtggcggagttaaccactaaacggaaataatcttcgctgaggaagtaaacaatcaaatcatcgataacaccgccggattcattcagcatcccggtgtaaagggctttgcccggttgggtcagtttggctacatcgttagccaacagatagcgcaaaaactcacgggtacggttaccgtgcaaatcaacgatggtcatgtgggagacatcaaacatgcctgcgtcctgccgcacaagatggtgttcgtcaatttgggagccataatgcaatggcatcatccaaccatgaaaatctaccatacgcgcaccgcacgcgacatgttggtcatacagcggggtctgcttagccatctttttccctcaatatacacttcgtgtttgaagccgcagggtacctgcttcaagaccacaataaacaggtagggacaccacgacgcaaacgataccttttgctcaacgttagcaccgatcccctcagggaaccataagctaaaataggcgaggcgccctcttcaggcgacaaaaaacagaaggattgtgcagagttttctactgtaaaactgcgtacagaggcacacaatgaacaattaattcgtaaaaatggcgaggttatataactaaatggccaaaagtctgtcggattaaactttttaaacttcgattatctgtgaaaaaaactaatgcgaaaaatggactgaaattagattatttcaactgagggagatcgtaggctgataccgctggggataatgaatacggcttattgatatccataacattttatccatccccataaatcacgggaatagaccacatagacgcagaataccggtattttgtgtcacccccccaagctcaacgtttatttatcgcgcaacattcgtcgcaaagcggcccataactcgggcgactgacaacccccaatgacacaatgtggggctgtgagtccagcacaatgtggggctgtgagtccaagccccatcagcgccagagcgcacgcggcttgaggcactaccgaaggctgctttagacacacactggcggtgtctcattaatacccgtaacggcgtattattgagaacgctccagccattctggcaaatcattcagccccatcgcctgccgtaccagttgcggtttaacccccggcaagtgatcggccagcgttaacccaatatcacgtaataattttttagccggattgttgccagcaaacagatcacggaagccctgcatactcgccagcatcatcgcagcactgtgtttgcggcggcgttcataacggcgcagatagagatgctgaccaatatccttcccttgacgctgtaaacgccgaagttcagacactaattcggctacatccataaagcccagattaacgccctgcccagccaatggatgcacggtatgcgccgcatcgccgaccaacaccagccggtgcgcggcaaagctacgggcataacgcccggtcagcgggaacgtttgccgctcactctcaagctgacattgcccaaggcgcatatcaaacgtcatcgccaactcacggttaaattgctcggcgggtagcacggctaactcggcggcacgctcaggcggtaatgaccagacaatagaactgaggtgggggtcgctaaaggggaggaaagctaaaatgccgtcaccgtggaatacctgacgcgcggtagcctgatgcggctcgtcagtccggatagttgccaccaaggcatggtgggcataatcccagaaggtcagaggaatatccgcatgctgacgtaaccatgagtgtgcgccatcagccccaacaaccagccgagcactgagcatccggtcatcggttagggtgataaacgcttccgtctcgccccaagccacttgtttgaagctggcgggtgccaagaccgtcacctctggtagttggctggcccgctgccacaatgcttgttgaatgacctgattttcaatgatatggccaagatggctgaagccatattcatccgcatgaaaggcaattttgccgaagctgtctttatcccacacttccataccgtggtacgggctagcacgcagtgcctgaatcgtttcccacaccccgattttttgcagtaagcgctcactagctgcgttgatcgccgagactcgcagtgccagctcaccggtcaacggtgccgttaatggcatcggtgcaggctgatgctcgataatggcgatacgcaggccactgccttgtaaaccacaagccagcgccagacccaccatcccaccaccggcgataactatgtcaaatgattgcatgccgaaacatttccccatgaaaatatgaactttatttactctatagatttctcgatgcagggaggcggcaaacgagaagcaaattggtcgggaacgatttgaacagcatttgtgccaccccatagggtaaacctcaacgatgaggcgcgttaatcccgatgagtctattgagttagcgctcgacccagcccaatgtacgccgggcaaaagtatcacgtattgtgggcatctgttccatggccatcagcgccaaattccgccctgcgactaacggcccatagcgattcgcaaacaaacggatcaaaccatcagtaacgccaatagtcgcctgttgatcctgctgacgccgctgctgatagtggctaagaacggtatagtcaccgagatcattccccatggccgcagcctctgcaagggtttcagccagtgacatcacatcccgcaggccaagattaaacccctgaccggctatcggatgtaaggtttgtgccgcattccccaccaacgccaggcggtggctgatatgacgtgacgcagtcagtaactgtaatgggtagctgtggcgtttacccgcctgaagcattttccccaaccgccaaccaaaggcttgctgtagctctgccaaaaaacgcgcgtcatcccagctatcgatctgttgttgatcatgcttcgcatggcaccaaaccaaagaactgcgcccctgagacatcggcagtaaagctaatggcccattgcgggtaaaacgctcaaaagcacggccattcggtagctcggaggtggtgatattcgcaataatcgcaacctgttggtaatcctgtcgctgccattggatagcgcaggattgggctaatgccgagtgagaaccgtctgcggccaccagcaattttgccgccagttgttgcccgtcatccaacgtcacacgggcggattcagcggtacgaaccacatcaaccactttggccggacaatgcagcgtcacccccggagctttcatcagcaaggcaaagagccgttcaccagcatcatgtagctcgagaacatgccccagcgccggtacaccgtaatcttcagcccgcaaattaacaaaaccagaatgaccgcgatcactgacatgaacatgatcaatggccgtggcacaatcggccaatgccgaccaggcaccaatgcgcgccaactgctggcaagtcccctgcgccagcgcaatcgctctggcatcaaagcccggatgttgccggtcattgggttgttgcgcctcaaccagtgcaacgggcacctgcccgtgagtaagggatgaaatggccagtgccagagttacccccgccattccaccaccaacaattatcacactcatcagttatctcgctgccatctgtgtttcaataccatcagtatttcaataccatcaatgattcaatgccatcaatgcttcaatgtcatcagggtctttaaccacgctcgcggtcaagttttcgttacccgtggcggtaatcacaatgtcatcttcaatacgaataccaatgccccggtattgcggcgggacatcggcatctggggcaatgtacaagcccggttccacggttaataccatgcccggttcaaggatacggccacggtcactgctaccgtaatcgccgacgtcatggacatccatccccagccagtggcttaggccatgcataaagaatggccgatgggcttgttcagcgattaactgttcgatatcacctttcagaatacccaactccaccaaaccgacgaccatgatccgtaccacctcttccgtgacctcacggatgctggtaccggggcggaacaacgtcagcgatttattgatagccgccagaacgatgtcataaaccgcccgctgagcgggggtaaatttgccatttaccgggaaagtgcgagtgatatcaccggcatagccacggtattcacaacccgcgtcgataaggaccaaatccccgtcccgcagctcacactcattctcggtgtagtgcaaaatgcagccgttttcacccccaccaacgatggtgttgtacgctggataacgcgcgccatggcgggtaaattcatgcagaatttccccttccaattgatattcaaacataccggggcggcatttttccatcgcacgggtatgggccagtgcgctgatttcaccggcgcggcgcagcacggcgatctcttcggctgatttaaacagacgcatttcatgcaaccaaggccgccaatcggttaacgtggctggcgctcggagatttttacgaaaaccatgacgtaatttttccagtgcagcaaaaacaatattatctgcgtaagcatattgcccttgagcgtgataaatcacatccaggcgattaagcagcaaatagagctgctcgttgatttcatcgaaaggtaatgcgcgatctactgccagtttcgtgggggcggcctcttgccctaaccgacgaccaaaccagatctcagcggttaaatcccgaacccggttaaacagcacgctgtggttatgagtctcatcgcttttaaccagaatcaacaccgcttctggctcgttgaagcccgtcagatagctaaaatcactattctgccgataaggatattcagagtctgcactgcgtgtggcttctggtgcggcaaaaataatagcagcactgccaggggccattttcgccaacagtgcctgacggcggttctggtattcttgctgagtcatgaccttctcctgaaatatccggtttgcatcacctgaaactcacttcaccacacttgccaattgataaaatcagcccattgttcaaaatcaatgcagtgtcggtttatgcatttcaggggcggtaggtttctgctgggtaaattcgatatggcacaaaatggccgcaacacgtacatactcgacaacttcttctaatgattgcgccagttcttcttgatcttcatcttcgtcatatcccaattgagcgatattacgcaagtcgtcaatggcttcccccacttcatctttcacctgtgccagcttcggctgcaacatccctaaccccaagaggaaatgatttacccaacctgataacgcatctgcgcgatcaaagacagtaacatcttcgccttcagggataagcaactggaacataaaaccttcattctccagcgcttcttgtgttgcttcatgtaactgttgtaacggcagactcagggcttgtggaaaagcaactccctcattggtcaagtcatgtaccagcgtctgccagccgttgtctttactgccaccacagagcattccgctgatcaacccatgcatctcagccggggttaatgctactgcttgctggctgagtgccaaggcaagtgatgggtaagttggtaatgtattctctatagacatgcgtattggtcatcgttggcaggataagttcatgttatgctaccatcaagatcagtcgctataccagaaaacgcagcaccctataccctatagatttcaagatgcaggaaggcggcaagccagaaagtcccaataatcttatcgataagtaacgtctacgacagataagtgatttgggtgagtggtagccgctaacacaccaacaacttggaagatgatggatattaaggggttgtatcttggtatcgaggtatatatagtgacgcccgctttgcagccacgagcaatttgcttctggtttgcagtgctggcgcgaaaattaggcaggaaggtagcatgtctgcacaaccggtagatattcaagtttttggtcggtcattaagagttaattgtccaccagaacagcaagatgcgttgaacatggcagcagaagatcttagccaacggttgcaagatctcaaagttcgcactagagtcaacaatactgaacagttagtttttattgcagcattgaacgtgtgtcacgaactggctcaggaaagattaaaaacgcgtgactatgcctccaatatggagcaacgtatacggatgctgcaacagaccattgaacaagcattacttgaacaaggtcgtatctctgaccgtcaagatacacagtttgaataaattactgtgtttgaataaattactgttgaatgatagattctacagtgagtaaagaatttctctgaggtgtttgccagcgggccagtcccctgagccgatatttaataccaatagaatgtagtgctccgtaaccggtgagcatgctcggtccgccgagaagccttaaggttgcgacgctgcgttcaccttgaaccaagggttcaagggttacagcctgcgacggcacctcggagatcccttcactatcgttgatgagtcgtattgatgatcaacagtattgatatccaaaagtagcgatgttcaaaagtagcgttaatcaatactctttgggttatcgactatatcctgatacaggcagtttttatgccgcaaaatccacaacatgcccttgagcggcaacgtatccgcgcggaaatccgtgagcatcggcgtctgctaacacccgttcaacagcaacaatcggcacatctggcggcacagcacattgccgagcaccccaaaatccagcaagctcacacggtagccgtgtttctctcctttgacggcgaacttgatacccagccaattattgagcaactgtggcagcagaaaaaacaggtttatttgcctgtcctccacccgtttagccccggtaatttattatttctgcgctatcgcccagaaagcccgctaacccgcaaccgactgaaaatccttgaaccccaactcgatgtgcgagaagtcttgccattgcatcaactcgatgtagtgattaccccattggtcgcctttgatcgccatggtcagcgtttggggatggggggcggtttttatgaccgaactctgcaacgctggcagcaaaatggcccttatcctattggattggcccatgattgccagttggtcgataagttaccgagtgaatattgggatgtgccgttgccagagattgtgacaccagcaaaagtgtggcagtggtgaaagaaaatcgttcgagataaaaaaaacaccggggatcctatggatccccggtgtcagactgctgacaaaccccgatgactcactcttgaacggtgaggataggcagaagagtaaagcgtccgcgccagggagggcgcggctcgagcctacatggatgtatttacggcgtctttacgatctgcctgttctctccgtcgcgggcactttgtcaataacctcacacctgagatcctatggatcccaggcgtttaatcatttcaggaattagtacaataagcgagcgcggatcgtccctggaatggccttcatcgcctgcaaggctttttccgcattatctgcatcatcggtttcaacatcaatcacgacataaccaatatcagcgctggtttgtagatactgtgccgcgatattgacattctgctcagcaaaaatggtgttaatgctggtcaaaatgcctggccggttttcatgaatatgcaacaggcgacgggtattatcaccatgtgctggcagagaaacttcggggaaattcaccgcagatagcgttgagccattatcggaatacttcgccagcttacccgcgacttcatcaccgatattctcctgcgcctcctgagtagaaccgccaatatgcggggtcagtaacacattatcaaattcacacagtggtgaattgaacgggtctttattggtcgcaggctcttcagggaagacgtcaattgccgcacctgacaagtgattgctggacagcgcatcgcacagggccggaatatcgaccacggtgccgcgagaggcattaatcaacagcgcacccggcttcatctgtgccaattgctcagcgccaatcatattcttggtagtgtggttttccggtacatgcaggctgaccacatcactcatattcagtaaatctgacagttggcgaacttgctgcgcattccctaacgacagtttattttcgatgtcgtaaaagaagactttcataccgatactttcagccagaatccccagttgagtaccgatatgaccgtaaccgataatccccagtttcttacctctggcctcaaaggaacctaccgccaacttgttccactcgccacggtgcgctttcgcgttagcagacggaatgcctcggaacatcagcagtaactcacccagtaccatttcggctaccgaacgggtattggagaaaggcgcattgaatactggcacaccacgtttggtcgccgcttttaaatcaacctggttagtaccgatacagaaacaacccacagcaaccaatttttctgctgccgcaaaaacgtcttcggaaagatgagtgcgcgatctaattccgataaagtgagcatcacgaatggatgccttcagtgattcggcgtctaaggcacctttatggtattcaatattgctatatccggctgcacgcaggttatcaaccgcgctctggtgcaccccttccactaacagaaacttaattctgtctttctccagtgatacttttgccatgtccccgaccctattttcagacttcagatgcggctgccgatatcgaatgaatccggtcagcaccctgtcaacataacaaatattacgtaagcagcaatacaaacgattgcctgcccatcaacataaccgtcagtgtgaatgttaatttatggaagaaaaaactagtgaaccgagagagggcgacaggttaatcaaaggaaatgaggaaatgtgatatatatcaccaaattcaatggttttaagaaaagatattcaaaggcaaaaaattatcagggtgaagccaaataaacgacaccctgaaaaattttagccaatcactttaacgccattggccgtaccaatcagggccacatcagcaccgcgattcgcaaatagccccaccgttacgacaccggcaatgccattaatttggttctctaaagcgatagcatccaaaatactcaagttgtggacatccagaataacgttaccgttatcggtcaggacattctgacggtattcaggcaaaccacccaatttaatcagctcacgcgccacataagagcgggccatcgggatcacttcgactggcagggggaatttacccagcacaccaacttgtttggattcatcagcaatacagataaacttccgggcgatagccgcaataatcttctctcgggtcagtgctgcgccaccgcctttaatcatctgcatttggccgttaatttcgtcagcaccatcaacatagatatccaatacatcaacgtcattacaatcaaatactgggataccatagcttttcagcttggcggttgaagcatcagaactggaaacagccccttcgatctgatgtttaatcgagcctagcgcgtcaataaaatgcgccgcagttgaacccgtgccgacacccacaatcgtaccgggtttaacgtaatctaatgctgcccagcccaccgcttttttaagttcatcctgagtcatggtaagttcactgcctatgatatgaaaacaaaagcttattatagaacatgcacagcaaaaatcgtctcaataaagcccgtttatgacagggttaattctagcgagatcacagttatacccaaagttattggtgctgcaaccaggcaaaatgagggaattctgatgggtgactcaagtcggtgattgggataagcgcgagcggcaatatcatgcctgaaggggagatacgcgtttatttaaagtgaatacctcagcattgccttatataaaaatgaccaaaatgtcacagcgaaatgtggcatagtgttgtatcgatttactattttggagagatgactccgatgaaacgcccagactaccgtacgctacaagcgctggacgcggtgatccgtgaacgcggttttgaacgtgcggcacagaagctttgcatcacccaatcggcggtatctcaacgtattaaacagttggagaacctgtttggtcagccactgctggtgcgcacggtgccaccacggccaacggaacaagggcagaaactgcttgctctactgcaccaggttgagctgctggaagaagagtggctcggtaatgataacggggtcgatacaccgttgctgctatcgctggccgtgaatgctgacagtctggcaacctggctattaccggcgctgaaaccggtgctggctgatttacctattcggctaaatttacaagtggaagatgaaacccggactcaggaacgtttaaggcgtggtgaggttgttggcgccgtcagtatccagccacaaccactgccaagctgtctggtcgaccaactcggtgctctggattacctgtttgtggcatctaaggccttcgcagaacgctatttccctaatggcgtgacccgttcagcgttgctgaaagcacccgcggtggcatttgatcatctggatgatatgcaccaggcgtttttacagcaaaatttcgatttgtcaccgggtagcgtgccctgccatatcgtcaactcgtctgaagcctttgtgcagttggcccgccaaggtaccacctgttgtatgatcccgcatctgcaaatcgaaaaagagctggcctcgggcgaactgattgacctgacaccggggttattgcaacggcggatgctgttctggcaccggtttgcaccagaaagccggaccatgagaaaggttactgacgccctcttatcctacgggcgtcaggtattacgacaggactcgtttattgggcagtagctgtttatgtttactgagcagcaactgttttattggcagtagctgcgatcgatgccgggttggctcccgtttgcagctcaaagaccacatcaacctgatcatcaaaattgatggtctgttgttcgtaggtttgctccaccgccgtgtcggatgccgctccagcacttttatacattcgagctaccggcattggctggtaattcgctatatggtaacgaatgctataaaccgggcctaatttaactttaaatccatcggccagtgcgccggcctgcgtaatcgcattctcaatggcttttttacgcgcctgctcacggtaggtttctgggctggcaacacccaactcaacggcacggatctcattcagacccgatttcaacgcaccatccagcaaatcatttaatttatccaactggcgcaatgtcacctgaacctgacgcacagcacggtaacctttcaatacggcttcaccgcttttctggtagtcatattcaggctgggtacgaatattagcggccttgacatctttcttttcaatgccacttttatttaggaaatcaaagtattgcgcgacgcgggtatcgacctgctttttggcatctgcagcatctttggcagatacactgacttcaattgcgatagtcgcgatatctggggttgcctcaacgctggcggtacctgaggtgacaacatgcggcccttctggcacttcggccgcttgagcttgcagcgccaaaggtaacgtccctaatcctatcattgcggccaaagccaatgtcttcaacttcacggtgcctcctaagatatgcatgacaaatgaacctgcacctgtcagagaatcagtgcacgacactcactgaaattccattaacatcgcgattcattcgccgttgatcactcattgttaataaatagaggtattaacctatcaaacgtagcatatcttattgagttagggattcagattagtgacaaaaactcataggccgaatccctgtcgtgccaattggaaagcaataaaccccattaccccgccaacaaataggttaatgattcgttgtgccactgggcgatttaaccacggtgataaccatgctgctagcaatgctaaggcaaaaaaccaaacaatagaggccgtgaccgcccctaaagcaaaccaagggcgtatatcaggtaatagctgcccccccaaactgcccaaaacaacaaaggtatccagataaacgtgaggattaagccaggtaacggccaataaggtgaccaatatgcgccagcgcccctgcgtgacactcgttgctgacgaagcaacaccatccccccgccacgccgccatcaatgccccccaaccgtaccacatcaggaaagccacgcccccccaggtcaccaatgccagcagtaaaggcgaacggctcaataaagcactgccgccaaaaatccctgcgcaaatcaagataatgtcactgagagcacaaagggatgcgctcatcaaatgatgctgacgcttgatcccctgattcatcacaaaaacattttgtggcccaagcggcaaaatcatcgcagcgctaaggataaaaccgtgcaaatagaccgctaacatactgttacccttaaatattgttacctttaaatactgttgtctttaaataaaagatagacaccactgaaaatacaggagaccgagtatcggcatattacggggagatgatcatcagaggaaatggatatttcttatcaagcataagacaagctaataatgcgactgaactgataaaacagcagagcgagtcaaataaccgagcgagtaaaaacgggcactgaggcccgtttaatctatttaccgcttaccacggtgaaaaaccttactccggcttctcggcttcggcttttgccacctgatgcaaatgcacatccatttgtgggtaagggataccaattttgtgcgcatccagcgcccgcttgaagttttcagtcaagtcccaaaacacctcttgcgcatcaccattggtcgtccaaacacgaacagcaaaattcagtgaggacggtgccatttcattcaagcgcaccgtcacccctttctcgtgtatgatccgactatcagctgcgatgatgtcaccaagaacctttttcaccacatcaatatcggcatcatatgccacaccgacaatcatgtcggtacggcggttcggctcgcggctggtattaataatattgttggcaataattttgccatttggtaccacaatgattttgtcatcaaccgtacgtagggtggttgagaaaatctgcacctgcaccaccgtcccggccacaccgcccagatcgacgtactcacccgctttaaacggacggaaggcgaccagcaacacaccagcagcaaagttagacagcgacccttgtagggctaaaccaacggccaaacccgcagcaccaatgaccgcaatgaccgatgcggtttgtacacccagccgccccagtaccgccacaatggtgaaagccagaatgctgtaacgcaccatcgctgataagaagtcggcaacggtgacatcaatgccacgcaatctcatcacccgattgagcatgccagatagcactttagcgatgatcgaaccgacaatcaggatcaataacgcggcaataatattgactgcgtattggatcagtaagtcctggttattcgccaaccaggtgcttgcattattgatcccttcaactacgtttagttcttccatttaaaccatcctacaaaaaagctccctacaggagcaattacgccaaaaaaaatcaccatctaacgctggcgactctagccaacggcctatgtagtagggtaactaacaatattgaatgttgccaattttcgcaaaaaatatcagcgcagcataccaggccattaagtcagtgatgacagtgaatcatattggattgtcagcaacgaaaaaaggccccgtagggcctttcagactgctgacaaaccccgatgacgcgatcttgaacggtgaggataggcagaggagtaaagcgtccgcgccaaggatggcgcggctcgagcctacatggatgtatttacggcgtctttacgatctgcctgttctctccgtcgcgggcactttgtcaataacctaaaaggccccgtagggccttttaggtcagtccgaacagactggaattacagtacgtcgatggcgttcagttctttgaatgccagttccagacgagtaatcattgtcacctgggcagcacgcaaccatacgcgtggatcgtagtatttcttgttcggcttgtcagcaccttctgggttacccagttggccttgcagatagccttcgttctttttgtaatagttcagaataccttcccacgtcgcccactgggtatcggtgtcgatattcattttaactacgccgtagcttactgcttctttgatctcttcagcagtagaaccagacccgccatggaacacgaagttcaggctgttatgcggcagattgtgtttcttggaaacataatcctgagaatcgcgcagaatagttggggtcagtttaacgttacctggcttgtaaacaccgtgtacgttaccaaaagaggcagcgatggtgaaacgtgggctgatagcgttcagtttttcgtatgcgtaatcaacatcttgtggctgagtgtacagagaagaagcgtccatgtggctgttatccacaccatcttcttcaccaccagtacaacccagttcaatttccagtgtcataccgatttttgacatacgagtcaggtacttgctgcaaatttcaatgttctcttccagagactcttcagacaggtcgatcatgtgagaagagaacagtggcttgccggtcgccgcaaagtgtttctcacccgcatccagtaaaccatctaaccatggcagtaatttcttcgcgcaatggtcggtgtgcagaataaccggaacaccgtaatgttcagccatctgatgtacatggtgtgcaccagaaatagcacccaagattgcagcaccttgtggagcatcagtcttcacgcctttacctgcgataaacgcagcgccgccgttggagaactgaacgataacaggtgcgcgcactttggctgcggtttccagcactgcgttgatagagtcagtgcctacacagttaactgctggcagagcaaagttattttcttttgctactgcgaaaactttctgcacgtcatcacctgtgatgacacctggttttaccgaaatcaaaaattttagacatgtaagttgtcctgtatcgtcggccgaagataaatgtgaataggttcgctgttacatccgcccaccgtcatggcaagaggaaatagcgaaacgggcggcattgaccccccgttatccaaattactgcttagcgcgctcttccagcatcactacggcaggcagttttttcccttcgacgaactccaggaaagcaccaccgccagtagaaatgtaggagatttggtcagcaataccgaagagatcgattgctgccaaagtatcaccaccgcctgcgatagaaaatgcttcgctttctgcaatggcgcgagccacgatctcggtccctttacggaagttagggaactcgaacacaccaaccggaccattccacagaatggttttggcatttttcaggatctcagccagacgctccgcagattcgtcgcccagatccaaaatttgttcgtcatctttaatttcgttcgcgggtttcagcgtcgcggctgccgtttcagagaactcagtggcaacacgaacatcagtaggaacagggatatcacaggtctctagcagtcttttcgcttctgggatcagatcagcttcgtacagagatttaccgacattgtggccttgagccgcaacgaaggtattagcgataccaccgccaacaatcagtttatccgcgattttagacaacgcgcccagcacggtcagtttagttgaaactttagaaccaccaacgatagcaaccattggacgcgctgggttacccagcgctttacccaatgcttccagctctgctgacaacagcgggccggcgcaagcgataggggcaaatttacccacaccgtgagtcgatgcctgagcgcggtgagcggtaccaaaagcatccattacataaacatcgcacagtgcggcatatttcttggacagggcttcgtcgtcttttttctcgcctttgttaaagcgaacgttttccagaacaaccaactcgccagctgcaatttcaacgccgtccagatagtccttcgccagacgtaccggagaagataacttctctttcaggtagttaacgacgggcagtaaggagaactcttcgttgtactcgccttcggtcgggcgacccaagtgagaggtaaccattactttagcgccttgcttcaatgccgcttcgatagttggcagagaggcacggatacgcgcatcagaagtcactttgccttcttttaccggaacattgaggtccgcacggatcaaaacacgtttgccagccagatccagatcggtcatcttaattacagacatggtgaatcctcttgttgattctctttaaagttgcataagctgcacattaacgcccataaaaccgcagtaaatcacggtaaaacaagacgttaatacgccatactagaaaccgcttttggccatcgccaatgtcgtatccaacattctattggcgaagccccattcattatcgcaccataccaacgtcttaatcaggtgctgcccactcacccgcgtctgggtgccatcgacaatagcactgtgcggatcgtggttaaaatccatcgacaccaatggtaattccgtatagtcaactataccacgaaatgcacctcttgctgccttttgcaaaagctggttaacctccgccacgccgacaggatgagtaacgctgacgcttaaatcgatagccgtaacgttgatggtcggtacccgtaccgagatagcctcaaacctgtcacaaaacttcggaaaaatgcgggtaatacctgccgccagtttggtatccacaggaatgatggattggctggctgctcgtgtacgacgtaaatcctgatgataagcatcaataaccggctggtcattcattgacgaatgaatggtagtgacagtgccagattcaatgccataagcaatatccaacaactgaataataggaataatgcagttcgtcgtacaggaggcgttggacacaatccggtgctctgcccgtaaatcctgatgattaacaccatagactacagtcgcatccaaatcatgaccgccgggatgggcaaacagcactttttttgcaccggaggctacatgcgcctcgccatcctcacggctgccatacacaccgctgcaatccagaaccacatctattcctaactcactccagggtaattgctcaatctctgactgatgaatcagccggataatatcgtccccgacatacaatgaatcacattcctgacgaacatcccaagcgaaccggccatggctggagtcatacttcagcaaatgggccatcccttccgcactcgccaactcattgattgcaaccaccgaaatttctgcccgacgacctgattcatacaacgcgcgtaaaacgctacgaccaatacggccaaagccgtttatcgctatgcggattgccatgtgactccctgcctctggttattatcatgcaaccccatagagtactgtagcgcgtccttagatgttaatcgtattatcacaattcggccataatactggccgggttttctcggtgggatctcattagatccgaaagcaaaccataactgaaacgcttcagccagaataaaccaaagtcatgataaaaggaatatttccctgaaaaagggcacaattcatctatgaattagtcaaaaaaaagaccgcaaaagcggtcttttaacaggtgcattaccgagattctcatcactgttcacacccatttgcagtattgataacgtcgttgcctgttttaacggctaatcgctctttagcgactaatcgcttcttaaccgttaattacttcagcagcgcctgagctttcgccaccacgttttccacggtgaaaccaaactctttgaacagcaattcagctggcgctgattcaccaaacgtggtcataccgacaaccgcgccattcaggccaacgtatttgtaccaataatccgcaatacccgcttctacggcaacacgtgcgctaaccgcagatggcaatactgactcacggtaagccgcatcttgtttatcgaatgcatcagttgatggcatagagacaacgcggactttacggccagtggccgtcagttgatcagccgcagcaactgctaactccacttcagagccggtagcaatcaggatcagttcaggctggcctgcacaatccttcagcacatacccgcctttggcgatattggctagctgctccgcagtacgtggctgctgtgccagattctgtcgagagaagatcagtgcgcttgggccatctttacgttccagcgcatactgccatgccactgcagattcgacctgatcacaaggacgccaggtactcatattcggggtaacacgcaggctggccatctgttcaacaggctgatgggttgggccatcttcgcccagaccaatagagtcatgggtataaacgaacacgctacggattttcatcagtgccgccatgcgcactgcattacgggcatattccacaaacatcaggaaggttgcgccgtaagggatgaaaccgccgtgcagggcaataccgttcatgatggcagacataccaaattcacggacaccgtagtgaatgtagttaccagccagatcgtcgctcaaggatttagagccagaccagatagtcaggttactcggtgccagatcagcagaaccgcccaggaactcaggtaacactttaccgaaggcttccagcgcattttgtgaggctttgcggctggcaatatttgctggattggcttgcaattgttcgatgaatttcttggattcaacggcccagttagccggtaattcaccgctgacacgacgtttgaattcagccgccagttctggataagccttggcatacgcagcaaacttctcgttccaggccgcttctttggctttgcccgcttctttggcatcccatgccgcatagatatcttgtgggatttcaaatgccgggtatttccaacctaatgcttcacgggttgctgccacttccgcttcacctaatggcgcaccatgggaatcatgggtgccagctttgtttggtgagccaaaaccgataatcgttttgcacatcaacaatgaaggcttgtcggtaacctgatgggcttcttcgatagccgctttgatggcgtccgcgttatgaccatcaacaccacgtaccacatgccagccgtaggcttcgaaacgggcagccgtgtcatcagtgaaccagccttcaacatgaccatcgatagaaataccgttgtcatcatagaaagccgtcagtttgcccagcttcatcgtaccggccagcgagcaaacctcgtgagagataccttccatcatgcaaccatcgcccataaaagcgtaggtatggtgatcaacaatgtcgtgacctgggcggttaaactgcgctcccagcgtgcgttctgcgatagcaaaaccaacagcattggcaatgccttgccccaatggcccagtggtggtttctacaccagcggtataaccatattcagggtggccaggcgttttagagtgcagttggcggaaattttttagctcttccatcggcaggtcataacctgtgagatgcaacaggctataaatcaacatggagccgtgaccatttgacaggacgaaacggtcacgatcagcccagtgtgggttagttggattatggttcagataatcacgccacaggacttcggcaatatctgccatacccatcggggctccgggatggccggacttcgctttttgcacggcatccatgcttagtgcgcggatagcgttggcaagctctttacgagaggacatgttttactccaggtcggattaacaaagcgttcaagattaccattttctcagactcagcattgaaacggcaatcactatactctaaataattcgagttgcaggaaggcggcaactgggtgcatccccaagagcttacacaagtaagggattggggtgaacaaaagcagccaccgcacagcgacaaaccataggctacaacaataatttcgggcaagacctattgccaacagagtagaacaagcgtgagcgatccaacaactattaatgcaattccaacagctattaatgcaatagctagtaatgatgtgattatgatgagcggatagcggtggtaaatagattgcagtgataaggagatgactgtgatgagtagatgactgtgatgagtaaattgcagtaataaataggtgactgctgctaattcgggccatcaccgatagaatagcctgcttcaaacgaaaaaatggccaacccacaggaagaacgtgttatgaaaattcgtacctcaatgattgcactgagcctggcggcactattaagtggctgtcaaagcctcaatactgaaggcttaatgcagtcaggtgcgcaagcatttcaggccgcaaccttgaatgatgctgacgtgaaagcccttagtgaaaaatcttgcgttgaaatggatcaaaaagcccagatcgcttcagcggatagtcaatatggtaaacgtatggcaaaaattgctgccgccttgggcgataacattaatggcaccccagctaactataaggtctatgtgaccaaggacgttaatgcttgggcaatggctaatggctgcattcgtgtctacagcggtttgatggatatgatgaccgacaatgaagtagaaggtgtcgtgggccatgaaatgggccacgtggcattggggcacacccgtaaagccatgcaggtggcctacggaacaaccgcgctacggacggctgtcgcctctgcaggcggtgtcgtgggtaccttgtcgcaatctcagctagcagatctcggtgagaaactggttaatgcccaattctcgcaaaaacaagaaagcgaagccgatgattactcattcgatttgctgaaaaaacggggcattgacccgaacggtctggtaaccagttttgaaaaattggcctcaatggaagcgggccgtaacagcagtatgttcgatgatcatccatcatcacaagccagagcagagcatattcgccaacgtattgcggcggagaagtaacacttaacgccagtctcttatcaatgcagacgccccactgttggggcgtgagttctgtagctgacgtttgatatttgatatttgatagctaatagctattagccatgcctgctactcgccatcgccatccaaattaacgtcgatctgatcgccattgatccgcacagcataggtgtttaaatcgcgatcgcccggctcacgcaaacactgccccgtccgcacattaaacagagcaccatgtagcggacattcaatgatttcaccatcattaattccttggcttagtaatgcataggcatgaggacaaatatcttccatcgcaaaatactcgccctccaccagataaatacccactctgttattacccgcttgagccgaaaacgggaaatctggtttgatatcattcaccttacagacgctgaaccagcccattgagatgcctccagattattattacgacgaaagtctaaaccgctaacataagtgtggtcgatattcgggcaatcaccaccgccttaggagagggtcgcgccgaataaatatcctccggcatagccggaggtttttcatatgcgcctataaggctctgttaccagccgcgccctaacaggcgcatcgcgatctgacatttgcatctatggattacttacggcccgtaaacgggctaccgggatacgggatcgagagttgctcacccattttatcctcttccaattggtgctttatgtattcttgtatcctggccgtgtttttccctaccgtatcaacgtaataccctcgacaccaaaactccctgttacggtatttgaacttcaaatcgccaaactgctcataaagcatcagactgctctttcccttcaggtaccccataaatcccgagacactcatcttgggcgggatctccagaagcatatggatgtgatccacacagcattctgcttccaggatattcacgtttttccattcgcacagttttcttaaaatactgccaatcgctctgcgtttttccctgtagaacacctgccttcggtacttcggcgcaaaaactatatgatatttacagttccatcgggtgtgcgctaagctcttttcatccctcattgggacccccttttgatttcttgttgaacatttgcagttgccagaccgcaaactgttttaacaaatcaaaaggggtttttataactgacccaaagctgaaagctttactgaacccccagcctagctgggggttttctgggcacaaaaaaaggacaaacctgagtttgccctttaatcgatactgaataaatcgttagtgattattcgtcttcaagatatgtgtagccgtacaagccagcctcaaactcttccaggaactgcgcctgcaattcggtatccagatcggtttcttttacctgaccgcggaaatgttccagcaatttttcagggttcaattggacgtattccaacatatccgccactgtatcgccttcatcggtctgctcaacctctaccgtgccatcagggaagacataaacatctaccgccgcagtgtcaccaaacaggttgtgcatattacccaagatttcctggtaagcaccgaccataaagaaacctagcaatggcgggttttccggatcatacggtggcattggcatggtggtcgccaccccatcaccatcaatataatgatcgatggtgccatcagaatcacaggtaatatccagcaataccgcacggcgctctggcggcttatctaacccttccaatggcaagaccgggaacagttgatcgataccccatgcatccggcattgactggaacagcgagaaattcacatacagcttgtcagccatccgctcttgcagctcatcaatgatgggccggtgggcgcggttgcttggatccaactgtttttggatctcattacaaatgcttagataaagttgctctgcccaagcgcgatgagtcagatccagcataccgtgagcatattgggtatggacgtcgtgtaaatccatttggctatcgtgcaaccattcgcgcagtgaacggcggttttccggttcctgcatctcctgccaggtatcccataaactttccaaagcacgtggagcgcccgcttccggtggctgcggctcacagaactcattgcgctctacaccgataacattggacaccaataccgtatggtgagcggtaaccgcacgaccagattctgtaataacggtaggatgcggcaaaccatgttcgttacaggcatcaccgataccccagataacgttattggcatattcattcaagccatagttaacggagcaatcagattgagagcgcgtcccttcataatcgacgcccaagcccccgcccacatcgaagcactggatattaacgcccagcttgtgtaactccacatagaaacgagcagattcacgcacgccggtggagatatcacggatgttggagagttgagaacctaagtggaaatgcagtaattgcaaactttccaggctattcgcctcacgcagcatatcaaccagttgtaatacctgcgttgcagacaaaccaaatttggacttctcacccccactggcctgccatttaccggaaccttgtgatgccaggcgggcgcgaacccccaaacgtggaaccacattcagccgctcggcttcttccaggaccattttgatttctgacatcttttcgatgaccagatacaccttatggcccagtttttcaccgatcaaagccaaacgaatgtattcacggtctttataaccgttacacacgataaccgaacgagtcatgccagcatgggccagcaccgccatcatctcagctttagaacccgcttccagccctaacggttcgccggaattgaccaaagactcaatcactcgacggtgttggtttactttaatggggtaaaccaggaagtagccgccttcatagccgaaagactcacgcgcacgtttaaacgccgcgttaattgaacgcagacgatgctgtaaaatttgtgggaagcagaacagcgcaggcaaacgttgcccttgttcgagctgcatctttttaaccagttgcgccagatcgacacgcgcctcacgaatatccggatcagggcaaacactgatatgacctaattcattgacgtcataatagttgccaccccagtaggcgacgttatacgtgctcagcatcttgctggcattccgatcattcatggctacctcctgcatggagcgtaaagaaacatgtgcgcccgcagttaacggacggctaatcaagttatcatcagacataattcgcctctattgcgatactgacgataacgtcagccactatcgcagctacaacctacaaggacaatccgtgtgaacgcccagatattacgctgaaagcctggttcacgagcggtttatcactcatcgattcattactaaggaaagagtaaacacgtttcagtatcaatacgtattaaggtttcgtgaatcggactcgccgcaaaatagcgccagctagccggattcagtacgtcgggtaaccgttaaccggcccgcgaatcctgggtcgcacccatgtgggtataacatcgggttgatggggtacaagaaaggagggttgcaaggggggattgaacgtcagaacgacgcaattgttgatatgcagcaaccagtagacaacggatcattaatccaaccacctccatgcatgccgctcacgattgagcgaacaaggctttattaatatacccttcttacttgaagttgcagcgatgttagcggttttttctcactcaaatcaccagtgtgagccacactcatcatgatttgctcgctacgcgcaactccattaaatttggtatagacagttaattcggtataaacagttagctcgttataaacaattagctcgttataaacaatttagttaacagttcgatgacgccactatcattttgcgttcacccagaatgcgttcccacaaaccgagcacaaaacactgagaatttaaccatgcgctgatgccatcttctgccattttcatcattgcttatcaaataagccgcgcgcgcagtttataccgataaccaaggcaaaatgcaaaatgaaatttgcagtgtcaccgtctcaaaccgtaaaaaaagcccgccaccgctaaatcgagaaatatcttaatacaaaaagggctggctttcagagcaaaagctaacctaaaatagacgtccagatgttaatacatccatactctttaattgctagaatgctaacaacgttatctccccaaagtcagtggcgtgacagtatgttccgctaacatcgctgcaacgtcaggcaaaaaggggagatgttgaaggtttctaagttgatagactgctaaaggctttgcctaaaggggcattgtgaacgaccaacacaacagaaagtcaggctctgctctgtctgctgttgcttggtttccagcgctatgcagtgacttctcacttgtatttcaaggtaaagaaaataatggctaaacacctatttacgtcagaatctgtctctgaaggacatccagataaaatcgctgaccagatttccgacgccgtacttgatgcaattcttgagcaagacccaaaagcgcgggttgcctgcgagacctatgtcaaaacgggaatggtattggttggcggtgaagttaccaccaatgcatgggttgatatcgaagagatcacccgccgcacaatacgcgaaattggttatgtacattccgatatgggttttgatgctaactcttgtgcggttttaagcgctatcggtaagcagtctcctgatattaatcaaggtgttgaccgcgaaaacccactggagcaaggtgcgggtgaccaaggcctgatgttcggctatgccaccaacgaaaccagtgtcttaatgccagcgcccattacctatgctcatcgtttggtagagcgtcaggctgaggtgcgtaaaaatggtgccttaccatggttgcgcccagatgccaaaagccaggttaccttccaatacgacgacggtaaaatcgtgggcattgatgcggtcgtcctgtcgactcagcattcagaagatatcaatcagaaagatttgcacgaagccgtcatggaagagatcatcaagccagttctgcctgctgaatggatcactgcccataccaaatactttatcaacccaactggccgttttgttatcggtgggccaatgggtgactgcggtctgactggccgtaaaattattgttgatacctacggcggcatggctcgtcatggtggcggcgcattctcgggtaaagatccatcaaaagtggatcgctctgcggcatatgctgcccgttatgttgcgaaaaatattgtggcggcgggtctggctgaccgttgtgagatccaagtatcttacgccatcggtgtggcagaaccgacctccatcatggttgaggctttcggcacggagaaaatcccagcagaccaactgaccctgctggttcgtgaattcttcgatctgcgcccttatggcttgattaagatgctggatctgttgcacccaatctaccgtgaaactgcagcctatggtcactttggccgtgagcatttcccgtgggaaaaaaccgacaaagcagcgttattacgtgatgctgcgggtttgaaataaatttcattccctgcgtacgacttgaagcggtaaaacgatgaagaaccaccctgtaagcaacacgctggcagggtggtttatttgtatgcaccctgggaaaatgcgcccccggaactgttcaagtgaaaatgaacccaacccgtggtgatgtcagcttgcatctggctatccaccgttttattcttccgcattatgagcacactaagaatccccatcgcactccaacaagcggttatgcagtgtctgcgtcactatttgcaactggctaaccagcatcttggcaccgcgtatccagagccaaaaatcaattaccatcagcgtggtaccaacgcgggcagtgcctatctgcaatcattcgaaattcgtcttaacccagtgttattgctggagaataagcagccgtttattgatgaagtcgtaccacatgaattagcacacttgctggtttaccgccaattcgaccgcgtagccccccatggcaaagaatggcgctggatgatggaacaggtcttaaaagtacccgccagccgcacccaccaattcgaagtggcgtcagtgcgcagtaagaccttcaattatcaatgcaaatgtcagcaacatgctttaaccattcgccgtcacaataaagtgctgcgaggagagagtgaatatcgctgccggcagtgtggggagaaactccagttcatcacaataaatcctgattaatgactaacgttacttgttataaaacagcacgttaacttgccatccatcataattatctataacctgcgtacttttcattatcgggctgttttgagatatgttacgcaatattttgttcttgctggttttatcttcgccactgttgcctctgatcagtcacagtcacggcatcaataacttctcccaggcgaaagcggtggccgctaaaattcaccaagatgcacctggcagcttctactgcggttgccaaatcgactggcaaggtaaaaaaggtatccctgacctaaacagttgtggctatcaacccagaaaaaatgcagcgcgagccgcgcggattgaatgggaacatgtggttcctgcctggcaatttggtcatcagcgccaatgctggcaacaaggtggccgtaaaaactgtgccaaagatccggtttatcgtcagatagaaactgacttgcataacctgcaacctgctattggtgaagtgaatggtgaccgtaacaatttcatgtactcgcaatggaatggcggcagtggccaatatggtcagtgtgcaatgaaagtggattttaaaaacaaattggcagaaccaccggtacgtgcacgtggtgccattgcccgcacctacttttatatgcgcgatcaatatcaactgcggctatccagccagcaaagtaaactctttggggtctgggatcgtcaatatcccgtcaccgactgggaatgcttacgcgatgagcgaattgcgaaaactcaaggtaatcataatccttatgtacaacgcgcttgtcagcgacccaaaagctaattgagctaattgagccctattttcagctcaatcgccctccccatcacaccttgtcacggatgtcgttattttctgatggggtgatgttattttctgatgacgtagtgctatttgctgatgaggtggtgctattttctgatgaggtggtgctattttctgatgacgtagtgttattttctgatgaggtggtgctatttcctgatgggctgcaattttcgattggctgaaacttccctgcctctgctatccttagctgcttatttattttgcgtttatttcgcgcggtactcatcaccgcacggtatgattttcgtttcaggacttagagcaaacccatgcgtataccccgcatttaccacccacagcccttgcaggccaataccgaactggcgctcactgatgaagccgcaaatcatgtcggccgcgtactacggatgactgaagggcaaagcctgcaattatttgacggcagtaatcagatttttgacgctgaaattatacgggcagataaaaagaatctgattgtccgactcgctgaagggcaatgggaagatcgggaatcccctctgaatttacatttagggcaggttatttctcgtggggaaaaaatggagtttaccgtccagaaatccattgaactgggcgttaatgtgattaccccgctgttttcagcacgttgtggcgttaagcttgatggcgagcgtctgacgaaaaaaattcaacagtggcaaaaaattgctattgccgcctgcgaacaatgtggccgcaatacgatcccagagatccgcgatgccatgcaacttgctgattggtgtgctgaatccgatgacagcttgaaactgaatctgcacccacgtgctagcaacagtattaataccctcccttcctcactcaacaaagtgcgtttgctgattggcccagaaggtggcctctctgctgatgaaattgcgatgacctcgcgcctcggatttacggatatcctgctggggccacgagtgctgcgaacagaaactaccgcccttaccgcaattactgcgttgcaggtgcggtttggcgatctgggataaacccctttcccactaggagaaaagaatgattaagctcggtatcgtaatggaccctatttcgtccattaacatcaagaaagacaccagtttcgctatgctattagaagcgcagcgccgtggctgggaattgcattacatggagatgggggatctctatatgcgtgggggtgatggccgcgcacgtacccgccgactgaatgtgaagcaggataaagataactggttcagttttggggctgagcaggacctgccgctctatgatcttgatgtcattctgatgcgtaaagatccgccgtttgataccgagtttatctatgccacctatattctggaacgtgcagaagacaaaggcacactggtggtgaataagccgcaaagcctacgcgattgtaacgaaaaactgtttacggcttggttcccagagttaaccccagatacgctggtcagccgcagtaaagaccatatccgcaaattccaccaggaacacggcgatatcatcctgaaaccactggatggcatggggggtacctcaatattcagagtaaaacaagatgaccctaacctctcggttatcattgaaacactgaccgaattaagcagccgcttctgcatggcacaaaacttcttaccggccattaaagaaggcgataaacgtgtgctagtggttgatggcgagcctgtgccttattgtctggcacgtattcccgcccaaggtgaaacccgtggcaatctggctgccggtggccgtggcgaagcccgcccattgagtgaaagtgattgggaaattgcccgcactgttgcaccaatactgaagcaaaaaggcttaatttttgttgggttggatattattggtgatcgcttgactgaaattaacgtcaccagcccgacctgcgtgcgtgaaatcgaagcggccttccccgagatttccattaccggtatgttaatggacgccattgaaagacgtttggctgacaaaaaggcctaatacataaaacggggtgtggtgtttttctaagcgctgcccccgtgactttatcctcatttatccgcatactggcacccgttcatccattaactcagcgacttctctatataatacaatgaatttacagcatcattttcttattgccatgccctcacttcaggaccctcaatttaaacgctcggttatctatatctgtgagcatgacgaaaagggggcgatgggtttagtgattaacaagcccttggaacagctcaccgtagaaacaatactggaaaaactgaagatcaaatccccctcacgcgacccagcaatacgtttagataacgtagtattagccggtgggcctctggctgaagaccgtggatttattctgcattcaccgcaggaaggctttgcttccagtattcatatttcaccagagacgatgattaccacctccaaagatgtgttggaaacactgggaacatcggggcaacctaaaaatttattagtggctctgggctacgccagctggcggcaagggcagttagaacaagagttactggataatgtctggctgaccactgaagccgatacccatattttattcaatacgccaattgccgaacgctggcaggcagcggccaataaactgggcattaatatctttaatattgctccgcaagcaggacatgcctgatggctaatcgcacaattattgcttttgattttggtaccaaaagtatcggtgtcgccatcggtcaggaagtcaccggaacggccagagcgctaaccgcgtttaaagcacaagatggcaccccggattggcagcaagtcgaaaagctgttgaaagagtggcagcccaatttagtggtagtcggcctgccgctcaatatggatggcactgaacaaccactaaccgccagagctcgtcggtttgccaaccgtctgcatgggcgctttggtgtacagatcgccttacaggatgaacgcctcagtacggtagaagcccgcgccaatctgtttgaccgcggtggctatcgcgctctggataaaggcagtgtcgatgcagcctctgcggtgatcattttggaaagctggtttgatgagcaagcaggttgaatccgcgatgttctgttgatcacaaacggtttcctactttccattcccgcgacctgaataagtaatccctgcataacgttgtatacttataactttgtatactgcggcgatgccaatcagcagtttaaaatattgcacacctcttgcaggtgtttttttacatttattgaggttttctcatgacaaaagtgactgttgctgcgactcaaatggcctgttcttgggacctgccgaaaaacattgaaaatgccgaaaaattggtacgacaggcacatgccaaaggcgcacagatcatcctgattcaggagctgtttgccgcaccttacttctgcattgatcaaagcccagagcactacgcactggcccaagagctggataatagtccattaattaaacacttctccaagcttgccgctgagctggaagtggtactaccgctgagtttctttgagaaagccaataatgcttactataactcgctagtcatgattgacgccgatggctcggtgctggacgtctaccgtaaaacccacattcctaatggcccggcttatcaggagaaacagttctttatccctggcgataccggttttaaagtttggcaaacccgttatgccaaagtgggcgtaggcatctgttgggatcagtggttccctgaaaccgcgcgcagcctggcactgcttggggcagaagttatcttctacccaacagcaatcggctcagaacctgcttaccctgaaattgacagccaaccgcactggacccgtgtccagcaaggccatgcagccgcaaacctggttccagtgattgcctctaaccgcatcggtactgagaaaagtaaatacattgatgggctggagatgacgttctacggctcctcgtttattgctgaccaaactggcgcgctgttagctcaagctaacaaaactgacgaagcggttctggtgcatgaatttgatttgcaggagatcgccgcccaacgtgcttcatggggcttgttccgtgatcgccgcccagagatgtaccaaacattagccacgtcagacggcaagacccggagataatttatgtcggtgcaagacacgatgttacaacaacaggcattacccggcacaccgcggcaggatggtttctttatgcctgcagaatgggcaccgcaggatgcggtatggatgctttggccatatcgtcaggataactggcgcggcaaagctattcccgctcagcagacattcgccaaagtcgccgaggccattagccgtgctacgccagtctttatgggcgttcccgccgagtttatggcacaagccaaggcaaccatgccggcgaatgtgaccttagtggaaatggccagtgacgatgcctggatgcgtgatacaggcccaacgatggtgattaatggtgcggccgagcgccgggccgttgactggcagtttaatgcatggggcggcctgaacggtggcttgtatgctgactggcaacaagatgaaaaagttgccgttcaagtcagtgattttctgaaaaacgcgcattacagtgcaccgttgatactggaaggtggctccattcatactgatggcgaaggcacgttactcaccactgctgaatgtttgctaaacccgaatcgcaacccacatttgaatcaagcgcaaatcgaacagttactgtgtgactatctgggggtgactcacttcatttggttgcaagatggcgtgtataacgatgagaccgatggtcatatcgataatatgtgctgttttgtccgcccaggcgaagtagccctgcattggacagacgaccagcaggatccacagtatgcacgttcagtcgcagcgttcgaggtgttatccaataccgtcgatgccaaagggcgtaaactgaaaatctggaagttaccggctcccggcccgctttataacacggaagaggaaaccttcgatgtgttgaccagcgatgcggttccccgcacggcgggtgaacgcctggcgggctcttatgtcaacttcctgatcagtaaccagcaaattattttcccactgctggatagccgcactgacgggcaggctaacgatctgttacaacaaatgttccccggctacgcaattgtcggcgtgcctgccagagagattttactcggtggcggtaacatacattgcattactcagcagatcccagcggcttaatccgcacaaaaataagccgcctgcttgacccggatcatccgatccgggttaatttattgcatcaccttctcccttgaaataactacagtgtcagcggtgcctcccccatcagtgattgatagccaaaaccccctgtttttgccgttgtgcgatactttgctcaaaggtttgcatcccccattgccctccggcctgtatcacggttggtaattgataggttttaccttctcggatcaaatggctgactgccgtggtttgcgtgagtatctcaaatacagctatacgcccaccgccattttgacgacacaatttctgcgtgataacaccgcgtaaactggcagccagttgcgtccgtataacggctttctcctcaggaggaaaaacatcaatcagccgatcaatagcctgtgttgccgtgcgggtatgcaatgtggctagcaccagatgcccggtttctgctgctgtcagcgctaatcggatagtctccagatcccgtaactctccgagtaaaataatatctggatcctgacgtaatgccccattcagggcacgactaaaacagtgagtatggcgaccaagctctcgttgctggatcaaacatgattgactgctatgaataaattcaatcgggtcctcaagggtaataatatgtcgtgcctgttgctgattaatcgcgcttatcatggcactcagcgtcgtcgatttaccgctgcccgtcgcccccgttaccagaattagtccattatcctgttgaatcaattggttcaaaataggtggtgccgccaattgtgtcagtgacggacaaatagcaggaataatgcgaaaagcaatggattggccctgtcgttgctggaaaatattcgcccgtaacctttgactgcccacggtggtataggcacagtcaacctgcccctgttgctgtaatcggctttcttgtgcgtcactcaacatatgccgacgtagcccatttaaccaaccagcagtgaccttcggccagtcagtaaaggtttttagctcgccatcgatacgtaatacggggtgaaaaccggtacagaggtgcagatctgaagcattatgatctacactagccgccaccttattggcaaaatcctgtttgttaaagccatcactggcaaggtcagggttttctaaatcaatgcgtttggcttttatacggctaaacacggggttattcagatctgaatgttgattattcaggcttgtgaaatccatatccaactcctgggtccatatgagtactatccaacagaatctacaggatgtcagagcgcggatcgcaacggctgcacacaattgcgggcgctctccagaagaagttacattgcttgcagtcagtaaaaccaaacctgtggcggctatcgaaaaagccatcgccgctgggcaatatgcttttggtgaaaactatgtgcaggaaggggtggataaaattcactccttcgcggataacaaaacgcttgaatggcactttatcgggccgctgcaatccaataaaagccggttagtggctgaaaattttgcctggtgtcataccgttgatcggttgaaaatagcccagcgtctgagtgcccagcgcccagcggctatgccagcgttaaacgtactgattcagattaatatcagtgatgagcaaagcaaagcggggatttccttgagtgaactccccgccttggctgacagcattagtacattacctaacctgtgtttacgcgggctgatggctatcccagcgccagaacatgattatcagcggcaattggccgtatttacgcaaatgaatcaggcgttcttgactttaaaagcccgctaccctcagatagatacactttctatggggatgactgatgatatggacgccgccattagcgccggcagtacactggttcgaattggtaccgccatttttggtgcccgcgtttataacgcggattaatcacagcatttattgttcactacacttacggaacataactctctgttgaacgtaattatttgttgaacatcagttcctgttgaacataagtcctcgttgaacataaagactgtgcacgcttaggagaattcgatgcagcatcgcaatattacattcattggtgctggcaatatggtccgcgctattatcgctggtttggttgccgggggatatccggccaaaatgatcagcgtttgcgccccttctgccaaaaaccgtgatgcactagccactgaatttggtgttatcagcagtgatgataatatccgcgagtcacaaaaagcggaggttgtggtgttagcggtaaagccccagttaatggccgatgtatgccagcaattgcaaaaacaggtcgattttagcgataagttggtgctgtcgattgcggcaggtgtccaggttgcacgtttctacgcgcttttggggaataaactgaatctggttcgtattatgccgaataccccatctctggtgggaaaaggaatgagtggtctctacgcccccgagcaggtttcagccgcagatcgtgatttcaccactgaactaatgagtgcaattggcaaagtatgctgggtggacaatgaggatggcattaatagcattattgccgctgcggggagttcacctgcctatttcttcttatttatggaagcgatgcagcaagagactgaacgcttagggtttgacagtgaaaccgcccgtcagttagtgcagcaagccgcttccggggcttgtgcgctggtcgaggctaacccacatgtgccactttcggccttgcgggagcaggttacgtccaaagggggaaccactgccgaggcaatccgggtgttcaatgaacagcacttacctgaaatggttgcccatgccatgcaagccgctattactcgcgcaaaagagatggaaaaactgttctaattagcggcaaaatttacaaaaaccgacaccgcccttggcactttctcgttaaaataggggccgttaaagtatgtgaatagattttttatttgtacctaaatgcccaatagattccaaagtgctggaaggtgggaaacgaatgacaaatcggcagggagccggtttgaacgctgcttgcagcggcctcccagaggcaatgcccatgaatgggctgagtaaccagaacaaccaacacacctgcacgttgcaagatgacgggcatacaatattaaggactaaggcaactcatgctaacgctgacttttctggcaaaaacggtcattgacctatatgtgatggtactgttgttgcgcatctggatgcagtgggttcacagtgatttctataatccattgtctcaatttgtggtgaaaataacccaacctattgttggcccactgcgccgagtggtcccctctctggggccaatcgatagcgcatcattgctgttggcatatttactggtggccattaagtacccactcctctcactgattggtcaaggcttcttgtcactcagcattgatcacctctttttcggccttattgggctggtaaaagcagtgggtcacctgattttctgggtcatgattatccgtgcactgatgagttggatcagtcagggccgtagcccggtagactacctgctgttgcagttaactgaaccattaatggcaccgattcgtcgtattttacctgcgatgggggggatcgatttctcggcaatggttgtcatttttatcttgtacctgctcaattctttagccatggaaacatttggggctatgtggctttcgctgtgagtgcagtcctctccaccgaaaacgggctgatactcaagctctatattcagcccaaagccagtcgagatcagatagtcggtttacatggcgacgaacttaaagtcgccattaccgccccgcctgttgatggtcaggctaatgcccatttggttaagtttatcgccaagcagtttcgggtagccaagagccaggtgattatcgaaaagggcgaactggggcggcataagcagataaaagtgattaacccgcagcagattccgccagaagtcaccatactgctcaagtgagttgatattcctccgcgagaattgggttattggttgtcagcccaacagactgtgctcaataccgatagccgtcagcccataaaaattcaggattcatcgatgcaaaaaatagtattagccaccggcaaccccggcaaagtacgtgaactggcaaacctgctggccgactttggtttggatgtcgtcgcacaaaccgaactgggtgttgagtctgcagaagagacgggcttaacctttattgaaaacgccattttaaaagcccgccatgcagcgcaaaccaccggtttaccggccatcgccgatgattcaggcttagcagtagacgcgttaggcggcgctccggggatttattccgcacgctatgccggtactgatgccagtgaccaagagaatctggaaaagctgttggccgcattgcaaaatgtccccgaggaaaaacgcggtgctcagttccattgcgtattggtctatatgcgtcatgctgaagatccaacaccgctggtgttccatggccaatggccaggggtaattgctcaccaacctgctggggctgctgggtttggctatgaccctattttctatgtacccgcgctgggtaaaaccgcagcggaactgacacgtgaagaaaagcacgcggtatcccatcgtggtcaggccctgaaattgatgctggatgcgctgcgcgatgcttaaattacccccgctcagtctctacatccatatcccttggtgcgtccagaaatgcccttattgtgatttcaactcacatgcgttgaaaggcgatgtccctcatcaggaatatgtagagcacgtactggcggatttggatgctgacgtgcctctggtgagtggccgtgaaatcagcactatttttattggtggcggcacacccagcttgctgagtgcagaggccatgcagcaactacttgatggtgttcgcgcacgtttgccggttgccagtgacgcagagatcaccatggaagccaaccccggagcggtcgaagccgatcgctttagcggctatcagcgagcgggtattaaccgcatatccattggcgtccagagctttagcgcacagaaattaacgcggctggggcggatacatgggccagatgaagcaaggcgggcagcagagctggcaacctcactgcaattacgtagctttaatctggatttgatgcacggtctgcctgatcaaacactggaagaagcattggatgatttgcgtcaggctatcgccttaaatccaccgcacttatcttggtatcagctgactattgagccgaatactggctttagttcccggcccccaatcctgcccgatgacgatgcgttatgggatattttccagcaaggtcatcagctactcagtgccgctggttatctgcaatatgaaacctcggcctatgccaagccaggttaccaatgccagcataatcttaactactggcgctttggtgattatctggggattggctgtggggcgcatggcaagatcacatttaacgatgggcgtattttacggaccataaaaaccaaacatccacgtggttttatgcagggaaaatacttggataaacaatatgaagtggcagcagtcgaccggccttttgagttctttatgaaccgcttccgtttgttggaagctgcccctcgggctgatttctatcacttcaccgggttaactgagagtactattcgcccacagttagatgaggcaatagcaaaagagtatttaatcgaaacaacagaatactggcagattaccgaaaaaggcaaattgttccttaactcgctactggagctatttttatagttgtgatagctacgctaataattgtgaaagctaggctaaaaatggcgatattcctaatccttcgagtggcaggaaggcaaccaacacacaagcagtttgcagtatgactggtgtctctgagggcagaaacctgccctcagcctctcttcctgctaatctattttgctatcaataagcggcaatagaatcactcacaaactgatgagtagttattgccatcgctgtttgccgctctagcggtagcgaatagctttcagttgattccaatccccccatagcctccgctaattggctaatatcttgatcaaatatgtccccttgattaagtactctctcgtcattaaataatttcagaggcccaagctgagtttgtaatctttgggtaaaagcctgctcaatgggaatgtttttatccaagagcagggtcaattcatcaaaactcatatcgtgttccgctaaacggccaacatgatcttttgttaaatttttctgattgaagtactgccttaagtctatgggctttctcaagacgagaggctgttcagactcactcactaccacaccatattccttaagcacctgaatatttgatatcagtaactcaaagtgcccacggcctgtgacatgatatttcatcgccaaattaataagactctggcggttgatcccacattcttgctgacacaattcaatatcggcctgtgccagatcgattctatttttgaatgtaaaatccaaggctttatcacttaatggcgattccttgagtaaacccagttgttccagcagataattaatttcattttggctacgtagatgataattttttacccatttggcgatatcgacagtatcgaactcctcgcgctggatccaggtaacatgctcttctgtaaggctaattcgttcggctatcaaaggttggaagaatgcatcgattttctgctctattagcggtagtgggtcagtgttacgggcgttaccacgccaggcaattgacgacattgccaccagataatccaaatcagcaacatcataaattggattctttgtcgcccatgctttaatggttcttagctgattgagggtgttatagccatcttgagaatcaagatcggctaattgcctcacggtaagggataatcccatggatttaagttgctggcataattgatagtattcatcggaatacggacacaggctgaatagttcatcaaaagtaatttgagagccttctacccaaataaaatcaactttattttcgtcagcaagataccagtcaacaaaaataatacgacctgatgtattatccgcgatattcagcaccagattattttcacgccgctctgctgacaatgtatgcagtagaatgtgcttatccagataaagatgatccagcccactggtatcggcaatgtttatcgctccactccctgcactataataataagtatcatcaccgcccccccctttcagcatggtaccttcgtgcccacgaatataaataatcgcatcattgccatcgcctgtatcaatataattacccggtaagaatgtcgccgaattaatgacaacctcatcattaccgctgctgacaacaggggcctgttgggctgctataaaaggatgaccatttttatcgaggtttatctgataatcaataaatgttccagtaacaggatctcgatattgtgactgcccacttttatccgttatttttagatgccgataacgttcatcgttcatatagttaactaaccgtatactctggtgtttttctggttgatcgcggtagcgtaataacaagtcatcatccgaacgctcaacaataacatcacataataaccaggatgacagaactaaattatctgaagctaatgagtcatcaaaattattgataataatatctgttggactcccctctttctcttgaattaagtaagtatcttgtccaccgcgcccctcgagtaacccttccccgcttaacacttgcaatagattatctttattatcacccaataattcatagcgaggtaaaaaccccattagcattgaatgttcttgaggtgagagcctaataaaatcaggtaatatagcttgccgtaaaacaatatctttctctccttctaccctttgaagatgagtcacctgctgctgttgataaccattgtctaatgagaaccgtacgacgatatcatcaggatctcccttacccactaattccttataattacgatcaaccaacgaggagtaatatgcgaccatattcggggagaattcagtaatttcattaaggtagcttggccacaatggcaccattgtaaacccatcaacagtctggatggtgaagttaagtacttgctgcttttgattgttatttatattatagacaccaaccaacctgatctgggtcataaatccattatcattgtttatattaatcaacacatcaatattatccaactcaatagattttatttggttgagcttatgctcaagaaagatattactgatttgcatatctgtattgttattttctgatacttcctcaattctaatctgtaacgatttttcatgagtactttttagaatatgataactatctaaccccgtgcctccctgggctaaaccagactgtagtgctaataaatcattgcctccattaccccatattttatcatcgccgcccatgccattaagataattatctacatcatttccgatgatagtatcattaacattttcatgacccagaatattttcaaaatcataaagtaaagcaacttgtttttcgacaccaccattcacctgactataatagcctttgctgatatcaataatactgtcaatttcatttcccagtacttctcccagagcgactgtatcatttccttcgccaccgctaaggatatgactcttagaggccgcagcactggtcaatataaacgtatccgcattttcaccgccttgatattgcttaaacccactaccaatagtaaatatatttttctttttatgataaccttttgcgacatcatcgcccccacctaaatcaaataaagcggcaacatcattctcttttatctcgcgaagagggtgagcaagcaattcccctgaatcagagagagagattaatctattctcaccttgatcactcggagatatcgctattattttatttttatttatttgagacagtctattttgctgataacggacactgtctcctccctcggtcttaatcgttattttattaaccatggaaggtgtatcaaaatgatactccccatctattttatcccccaacgcctgataataaattccatcattaagaatgataactaaatcaagccccccgtctttattgagatcagttaattgtaactgtgaacgatgaagattagaggaggagagtaatgatgttagttcagaagatagcttggtcttatgctgcctaaaaacaccactactatttcccatcaggtgtaacatatcccctgatttatttagcagtaaaatatcatcaaagccatcattattgatatcgccaacaagtgaataaggataatttttacttttttcaccctcaaatgccagcctcactggctcaataaaatctccgatattaattacattgtgattatcttttccactctgattaaaatccagactatcataatgataagttgtcattttatcatcatgaaaaataaccaattcaaacacgttatcaccgttaaaatcccctagcacagggaacacaacttcattaaatttatcgacttctattgcatgaaataatttctcccactccagccttgtatctatttttaggtagctgccatccggctgagccaaccaagtgtatagctcataatgccagcgactaacatagtcatcaatcactgtcatacccactgaattttttcttgatgctattgttgtattatatttttcgttgatcacgataaaatcgtttagcccattacgatcaacatcagcagaaaggataaatgggctataggtagaatcaatatcaagctcagagaacgcctgatgcagatttttattttgtagcttaactacactacgattattatcctcgaaaaaatcagcgataacataatcgtcaacatcatttattttatccagttcataatactcatgctttcccatttctgcataagtggtataaattttggcattggtaaagggatcacctgaaaaaatactgattttctccagatctctctctgtctgcgatcgttcatctcgttttataaaagggatagctttaagaactgcttcgccccggctataaaatagcgtatctacgccctgtttactcgctaatagcgcctcataataatctctctgtcgctggtaaacactttccatagtctggttatatctaatctgattatccagccccggtgttaaaccaaattttaaaaataaccgcaagccattctcaaaccgttggcttcccgtcatatcaggtacaatatcgcggatcctttcaatctgactaacggctgagtaaatatcgccaacaataatcatggtaaaagccagggcaatacccgccggcccagcagctgtagcagcagtcccccccattgccatggcaaacgcgacgcccaaaccaatggttgcattaatggtcgaaaagaccccgctggcaataagatctcgtctaacatgaggatctgtttctgtcgccaattgtgaaaatgcatggtatgcctgatagatatcaataccagaagtgagtgctgagagcagtggcatactaaaacgtgcagcaccatgtgcgaattggttgagtgctaattttcttaggtctttaagaaaacctggggccaatagcaatgcagggttgcgttttaataatgttaattggctcaaaagggccggtgacaacctccctcctttactcactaatttttgtaagtagccaattccccacttaccaaatgcatattgcaagccatcggtcgccagattagccccgatacctccccaggccatggccaattgcaattgtatttcttcctcttgtttttctgttaagtcaccgttactcatccaacgttggtaatcagcagataaacgtaaagcagaaataaagccatatccctgcataccataaccaaatcgcccaaaaatcgctgttcttgctttaggattagatgtttttagatcaggatcagatgttatcgagtgaggataagtcgctaaatcagttttatgctgtgaacctgatttaatccttacatcttgtaacgtattaccatcagtctctgttattcgccaacggtcagttactcgccaaagttcagtatcaaaatctggcctgtctgatattttctgtaaaaacagcaaatcatatttcaacgtctgcatacgccaagagtcatgtaaggttaataacaattcacctttattcagtttcttatctgttaactgtggaaatatttccgctaatttacgctgttgttttttattaatttgattgactgacaattgtcttgttatcaaattatccagtagactatctatattattcaaacggccatttatgtcttttttgcgttctgttgttatctccccccaacggttccaatataatttttcagttccttttattgacgataagtatttattgttgtagctatcaatatcgggagtatccacatcatgcttatgccccagaggatcaacctcaatagcctttgttgacgctgaaacattggttctaatgccattttcattcaaatgagacataaatttatgtgcaaaactggtatatctatcactactactcatcgcacaccccaccaaactgacttgctgaggtgaaatattgatctgatgctcagtctgtaaatagtcagaaaattgattcaagcgggctgttagttgctcgggtcgttgcccagccagtgtcggatgcttatcattgccaccttcagaacggccatgcccaacaacttgccaccgtattttaccgttttcaggctggatttttagtttagtgacgagttcattatgactaatttcacgccactcggcgtgaatattatcgtcaatgataaaagccctgtgattattatcaacatctaactgaataataattgaattcttagcatgtttacccgcaagtctcgtcgctgcacgattaaccgttgggttattttcacattgaaaaacaatctgcatatcgtattgacttgccgtagccgttttatcgatattggcgatagcaggcagatcccattcattaactttaacaatgtctggatattttacaacgggttcatctagtgttgttataaggaagccagttgcattattagcgacgactaactgccaattatcactattacgtaattcaggacgctgcctaataatatcaaggaaattttcaaattttgaatgcgtattagagtcattaatagttaattctaataaattacgatcaataacaccgttattatcagagaagaaaggcactagatattgtgaataagactcaataagttgatcaacagactttattttatcccttacatccttgagtaaaagttcaactgccgggataccatcgataagtaatatattatttttataatgatataacacctgatagtcgtctatattttccagtacgcctccctggttttccgaattaaataccactaactcaccggggtattctactgaaactcccacttttgttgtataggccaatataggaatgtcaaatccttcctgatgcatcatattgacaattcccagggctggatgagtaccattaaatccctgtgctccctgtccattatcagcaatactgcatattactaatctaatctttaccggaggaggcaatgcgaatgaattagttgtaagtttataaatatcaataatattagctatactaaaactatataatccatctggagcgccatgagtcacaaatgataattcaaatccccccatttcggctatgttactcggaacaccataggcaattctcgcctcagaacttctggcatcgaattgcaatacgactgatttatcatgatgatacgaggaaagaacctcacccactctcttagaaagagaatcatcttgtaataatacaataaactgtggatattgatttttattattttgtttaacggcatattctaaaacaacatttttatcaattttatcccaagtattcatatacataccaggtttaatgtcgtatgaaaaaaaacgagtgaaatcttttatctcctgtaatgaatttacattatcatttatgtcatttgataaactatctaatattttattatagtgaggatgcgaaaatggatgtttactgttttttaatagagaatctatatctaagagattctccataactttaggatgcgtatcaggaagtatcgatactaatctaacgtgtttgtttaacaaacataatattagtgctacagaccttgattctgcattattcatatttactgatgtggttatttcatttataatttttatttgatctgacagatctttcttataaagtagaacccatgttccttcatctctataagcaacttggtacgtctccctttcattatgggcaaatatacattctttattttctgcatttttctttacaataaggtactccggtacatcatcaaaaaataaatagttattttcgataaagtctttaatcgattttaaattataatcattattagggtttataattacatctcgactatcctcaggatctgatattaaatagaggacaaacccattgtcatttatctttatgcccaaatcattactttttagaaaatagtcaaactcacttaatttaactttttctatcatctgctgatcattatgccaacctttatcacctttcctctctgctaatactgcatcaccactcataataacattttcaattaactgtaaatcttggggtgcattttttggggtgaaattggccaataaaaaacgttcaagagtagccatctgttttaactgattacggttagcatctaccttaatcattattttcctaccagcagaaaaatgtatagtgagtgttccatctactaaactacgatcactgattatgatatcccatttttcccgtaacaaattaaaaggaatgaaagtgttttttaatttacttgtgttaacattaatcacatcactattaaaatccagagggatagggaattttttaatatcacgaacattagaaaaaagtagactttctttttgtaataaattttcaagaataacttttctttcattaacatctattgcgggcacattatccaaccaactttctatttcactgcccacggctatttttttcttgataaaatctatacgctccgcttctattaatactttatactctgtaatctcatctaactgctcatgtattttgctaagaaaatagcgtagcaactctacttcaggtgcatttctatcaatatcgattgtattaataatctcttttctaacagtaaataaactgggctgaaattcctcatctaaccattgttggtaaatgtcgaccaatagcttttcttgcaaccaaacaggaagaaactgatactccgcagtcattgaaagatcttttgctgtcagcaaatcccccaactcatccagtggtgtatctttataaaactctaaaggtttatgaagaatacggatatcgcctatcaatccttgcttttgcaatgcacgtagtacaggcaactcactgttccaaaaatagttatttatccgtaggccacctggtgatgataaataaaccgttccaccgcgctcagcgctgtaggtggcataaaatgaactggcatatgaaatcattttataccgaaggtgattgattaaatccaccatcgccttatccgatggattaataatattaagtttcagtgattctgccatgtcaatcataaatcgtagaccagtgatactttgtatatcggatagttcagttccacttcctactaataaatcacctcgccacacatccatataagtgtgaatatcaccactaaaatagatatacaatctactcccgccctcttcttgtggcagtggaggtgtcacagatatacctaacgagctaatatatataattaactcattaaatcttccatagtcattgtaaagagctgcatcaattgccagatcagcaatttttattttttcttcttgcgttaaagtggtcggtacagaaaaaccctctctaattaaactataaagttgcgcgtctatatatttaatgaatcttttcttgatcatctcaatatcagcataagaatatttaaacttttcttttttattgtttttattaatccgatcatatgtttcagaaagaatagaaagccgttgagacaatgacaatttgtttatataaaacccagccatttcatttccatttggcatataaaatccttatataataaataatagtattgaattaaaaacaaacgcatcaattacaaataaatatagttacttcaaataaaagtagtcattaaaaatatttttaatgcggatttaataataaaacagatgaagacaaaaaagacaagtttacaattaacactagggttaatttattttcatagaaatgaatagaataatgacaagatgatttattgaagatcaacaacaggccagcacacaggtagtttgcagtatgacggatagatgacgggtttaaatttggaggggaattatcccctcagactgcggaagcaccccgatgacgcgatcttgagtggataggataggcagaagagtaaagcgtccgcgccacggatggcgcggatcgagcctacatggatgttatttttatgcagggaagatggcgtatttacgatctatctattcactccgctacaggcactttgtcaataacctcaggggaaatatcccctccttctattaccctaaggatttaagcaactcgatacgctgctgttccaaagtggtcactcgcccacaaacctcgcggccaaattgctggaaatcttgctcctgatcgttccattcatttttgatagcctgctgtaagccgcccagattacctagaatggcctgcaatggattattaccactactggtggcctgcttaacccccatctcattcaggctatcctgcaacaccccccccatgctctgctggaccagctcacggccatctttttctacctgagcaatcgcctgatggtggaaagctaaaccgtcactgcgtttctcgataatgcgagccatctgctgcttgagttgctcacttaacgtcgtcagacgattacggacattactgctgctaccgagttgctgaacaatgactttatccaaagaaacccgtgctttttccaaacgttgttgtgcgccctgatcaatccatggcaagtctttacgcaatgctgtctgataacggaatgccttctgacgctgtgcatcagtcagcgtcaacgttttgccattacgcgtgacatcaccatcaggtgaaatctgtaagttgccactggccccgacaatttgtacagattgcgggctgatgatcacatcatcttgtggttttacgctgcactggtattcagcctgcgcctgcccagcagtgagcatcaacaatgccaaccctgcagtacgtaatacttttattttatgtaacataagactcccgaaaaattgtgccattcgattgctgcctgactgcaacctcgagtactttggtctatctctatactctgccagaacttatctttaagcagaagaagagctgtcttaaaagatagaacgaccaatttgttgcgccaatctctctaaggcagcggtacccgccaatgagttccctgcatgatccaattcaggtgaccaaacggcaatacagaactcatccggaacaatggcaataataccaccaccaacccccgatttacccggcatcccgactcggaaggcaaactcccctgcaccatcatacatgccgctagtgatcatcagagcattaatttgccgcgcctgcattggggtaattaaagactcggagccactgatgctgcgcccctgattcgccagataaacaaagcaacgggccaactcgacacagctcatacgcatcgcacagtagtggaaataggtctgcaataccgtcaatacgtcgttatcgaaattaccaaaagacttcattagataagcaatagccgcattgcgatctgaatgctcaaattcggaacgcgccacacgaggatcgtaactgatgctgtcatccttcactaactggcgtacaacttccaacagacgttgttttggggcactcaggcggctttgcaacatatcgcagaccaccagcgcccctggattaataaatgggttacggggttttcccttttctaactccaactgaaccaatgagttgaatggctggccagaaggctctttacccacccgctgccaaatatcttgctcactgtaacgggataaggccagcgtcagacttaatactttagaaatcgattggatagagaagcgttcatcggcatcccctgcctgaaatatctgaccatccagtgtacaaacggcaattcccagcttattggccggaacctccgccagtgcgggaatataatcagcgactttaccctgaccaatcaacgggcggacctgctgtaatatatcgtttagtaaggcattatctaacgttgttaccactacaaggctcccaataaaaacccgctaacaatttccactaattacagccagtaaaaacaaaggcgccggttagggcgccctgtttaatgatcagccgttaaaacgggagatcaatcccaccagatatcaaataactcactggtttctacatttttcaacttacgtgcttctaaccatttggtgaccagagcacggtgctcatcagtacaatgaccgatttcttgtaggcaaatcaggccttcccactgtaaataaccacttccgtcaaatgccagaccattcgcttcaatgacttcatcgataaacgcatcaacggtttcatcaatcacatcaacgctagtgccttcatcaaaagcccactgtacggaaaaacccaattcttgaaactcgtcgatatgcatctttttgcgtaaacgacgactgcgattcttagccattattctttcctctcaaacatcaaatcccaaacgccatgtcccagacgctggccacgtaattcgaattttgtcagtggacgtgagtccggacggggtacgtaatcattttgctctgaaaggttgagataaccgctcacacccgacatgacctccagcatatgttccgcataaggttgccagtcggtcgccatgtgaaatacgccccccacctttaatttactttttaccagctcgacaaacggtgtttgaacgatacgacgcttattatggcgcgctttgtgccatgggtcggggaaaaagagttgtaccatgtccagtgaagcctctgggatcatattctccagaacttcgaccgcatcatgacacatgatccgcaggttactcaggccggcgtcatgtgctgaactcaggcaagcaccgacccccggtgaatgcacctcaatgcctaaaaagttttgctgcggattattggcagccatggtcaccagtgaggtccccataccaaaaccgatttccagtactaccggggcctcacggccaaacaaggtattcaagtcaaccggggccgcctgatattccacgcccatcaccggccagtaactgtccagagccagttgctgccccttggtcaggcgcccctgacggcggacaaaactacgaatacggcgcagtgctcggccgttttcatcaaattccggagatatgacgtcatttatcattagtgctttctatctgttggttgtgcatatgaacgcgcattatgcaaagatgcgccagtttatcaactatgaacgtcataagtacaaaattaagcggtaaatagattatatagacttaaaatgattggtgttgcagtaaagaaacaagtgaatcccgatgagcttactcattttaaaatcaacgaccagtaagtgattcgggtgacaaatctgccgggagcagatttgaacgctgcttgctgcggcctcgcagaggcggggtccatggatggaccgagtaacgagcgccgctaacgccgctgcggcgtcaaggacgaagagtataaggaaagttccggtttacagcacaagaactctatgctgcaatccagctctcatttatttacctgtcggatatcgatacctgcttatgatgcaagcgcaacaattcgcgcacgtggtacttgattggtaccaacactttggccgcaaaaccctgccatggcagttggataagaccccctatcaagtatggctgtcagaagtgatgttgcaacaaactcaggttgcgaccgtcatcccctattttcaacgttttatgctgcgcttccctgatattcaggcactggcggctgcgccgttggatgaagtactgcatttatggaccggtttgggttactacgcccgtgccagaaacctgcataaagcggcccaaatggtcgtggaacaccatcaaggggagtttcccacaacatttgaccagatactggcattgccgggtatcgggcgctcaactgccggggctattttatcgctgtctttaggccagcattttcctattttggatggcaacgtcaaacgggtgctggcccgttgctatgccgttgacggctggccgggaaaaaaagaggtcgaaggccgtctgtggcaaatcagcgaagatgtcacgcccgccaaccgggtgggccagtttaatcaggcaatgatggatttaggtgcgatggtgtgtactcgctctaaacctaaatgtgaactttgcccattgaatatcggctgtatggcgtacgctaaccacagttgggcgcgctatccgggcaaaaaacctaaacagacgttgccggaaaaaaccgcctggttcttattaatgcaaaatggatcgcaagtgtggctcgaacagcgccccccagtcggcttatggggcggcttattctgtttcccacaatttgctgaacaagaagaactcattcactggctgcaaaaacagggtattcccgccaatgaaacccagcagttaaccgcgtttcgccatacgtttagtcatttccatctggatatagtccctatatggctaaatacggcctcagtccgaggatgcatggatgatggcgcaggtctctggtataacttagcccagccaccttcggtagggttagctgctccggttgagcgtttattgcatcagttattaaaagatccgttggcaaaagatgagttaacgcaacaacaactcacaaagcaatcacctacccaaccagctttatttgactagatacccaaagaaattggagatgcaggtaggcagcaagcgaatggcaaatcggcctgtgccaatttgaactgcattcatgctagcccacagggggagtgaacatcgctaactatcattgcgacaaacaccccgcagcttcaaatacgaaaggtataacgccacaaaagaggatttagcatgagcagaacgattttttgcacgtttttaaagaaggatgctgaagggcaggatttccaactttatcccggtgagatcggcaagcgtatctataacgaaatatcaaaagaagcctggtcacaatggataaccaaacaaacgatgctgattaatgaaaagaaactcagcatgatgaatatagaagaccgcaaactgcttgagcaagagatggtcaacttcctgttcgaaggccaagatgttcatattgcaggttatacgcctccgagtaagtaaccacacggggccaattaaggccccgctgttatttcctaaatagttcgagttacaagaaggcggcaactgagtaaatccccaggagcttacatcagtaagtgactggggtgagcgaaggcagccaacgcactggtagcttgaaatatgacgggtaaattcctcatcaagatatggcttgtaagatgaagaaaattttagctttgctggtaatcgcccccttattagtgtcttgttcgggcaacaaaaatcaggttgaaaacgaagtttttgtcaaagacaccaatggttttgagattttaatgggccaatttgcccataacattgaaaatatttggggcttaaaagaagtcttaatcgctggtccaaaagattacgttaagtacacggatcaatatcaaacccgcagccatatcaattttgatgctggtaccattacgatagagacgatcgccacgaccaatccggcggcacatttacgtcaggcgatcatcacaacgctactgatgggtgatgatccaggctcgatcgacctctattctgatgtaaacgatattcagatcagtaaagagccgttcctctatggccaggtgctggacaacaatggcgaaccaatccgttgggaatggcgggcagcccattttgctgattatttgctacaaaacaaaatgcaaacacggacttccggtttgcatgtgatctcgttcgttaccatacagttagtgccaaaccatctggacaaacgggcgcataaatacctgccattggtacggaaatcagcagcacgttacggcgtggaagagtctttgattctcgccattatgcaaaccgaatcgagcttcaacccctatgccgtcagccgttctgatgcgctcggtctgatgcaggtggttcaacatactgcaggaaaagatgtattcaaactgaaaggcaaaagtggccaaccaagccgcagctatctgtttgatcctgaaaataatatcgacgcaggcaccgcatatttatctattctgcaaaatacctatttgggggggattcaaaatgccacctcacggcgttatgccgtgatcacctcctacaacggcggcgcaggtagcgtattgcgcgtgttccacagcgataaaaataaggcagtgggtatcattaacacgatgtcaccaggggatgtgttccaaacactcacgaccaagcatccatcaggtgaatcccgccgttatctggtgaaagtgaacagcgcacagaagaactatcgccgctattagtggttaataagtaaatagtggttaataggcaaatagtggttagcaggcaaataatggttagcaaaccgatagtgattagtcagcagaaaaaataagcaatcaggctaccggacaccccttccgatgattcgcccttaagcggtgaggataggctggggtgtcaggcatctgtacctacagcggccatcttacctttcaacacattttttttgaatatctcaaattgatgttacaaacgattttgattatcattcgccctctttttttagccagtgataattatgcgtctgttgttacttattttcctgctctgcacttgggcagttagcgccaaaacgattaccgatattaccggccaacgcatcgaaattccggataacccacagcgtatcgtattaggtgaaagccgtatgctatataccctcgcgttgctggaaccgggctaccccgccgctcgcgtggtgggctggccgttggacctgaagaaatacgatccgcaaagctgggcgctatataccgataagtttccgcagatgacccacattccggctctgggcagcacgggtctgcgcgatatcaacccggagaaggtgctggagttggcaccagatctggttatcctgccagtactcgctaaaaccactcatgaagaaatcgcgctaatttccctgctcaagcaagcgcatatcccggtgatccgcgtcgacttacgcgtcgatctgctcaatcacaccattcccagcctacgcctgctcggcgaagcactgaaccgccaagatcgcgccgaagcctttatttctctgtatcagtcccatatggatcgcatccaccagcgcatcgccgcttatcaggggccgcaccctagcgtgttgctgcaattgcatctggggcgcggtgacgaatgctgcaccaccacgctaaagggcaatctcggccaactgctggagtttgccggtggtaacaacatcgctgccgcacaagtgaaaggggtattcggccagcttagcgaagagtatgtgctggcccgttcaccagagatttatattgctaccggcatggcaacggctggcagccaagccaaaacgctggcgctcggcccacaggtcagcaccgcgcaagcgcaggagagtttccgtcgcgttatcgccacgcaaagcaaattgcagcaccttcctgcgattcaaaatggtcacgcttgggggttgtggcacaacttctatttaagcccgctgcatgtagtggcggcggagtttttcgctaaaacgctttatccacacctgtttgccgacgtttcaccacaggatacgctgcaaactatttaccagcagtttttgccgctggatttcacaggaactttctggagccatttggataatgaataaaataaacatgttcatgctatccacgttcatgcgatccatgttcatgcgatctacgttgataccctctacgttcatactgtccacactactgctgccggctgccgtgttggcagaagatacgataatcgttgagagaaatagatcgcaaactgatagctatcaagcgaccaccagcgtgacagccaatcgatcgccagccaacattatcgataccccgcaaaacgtgactgtcgtgacacatccggtgttggaagattatgatgtgaccaatcttggcgaggcgctttattttgtcagcgggattacccaatccaacacgctgggtggcacgcaagatgcgctgattaagcgcggtttcggcaataaccgtgacggctcaattctgcacgatggcatacgctcaattcaggcacgtaacttcacgcccaccagcgaacgcgtcgaggtgctgaaaggcccctcctccatgctatacggtatgaatgaaccgggtgggctgatcaatgtgatcagcaaaaagccacaactcgatccccatgtgcatttggaagccaacgccagtagtttcaagggtggcggtggccaacttgatgtaaccggccccttgggggaatccggctttgccgggaggctgattatcgatcatcaggagaccgattactggcgtaactttggccgtaaccgccagactgtggtcgcgccatcgcttgactggtacggtgaaaacaccaccgtacacctcgcttgggaacgaatggagtatttggtaccgttcgaccgtggcacggtgattgacccacgcactggcaaacccgtcgacacgccgcgtgatcgccgtttcgacgagagctataacgccacccgcggcgatcaagacaccgtcacgtttagcatcaaccacgatctgaacgagttctggtccacacagctaaattatgctttcagccgcaatagctatagtgataatcaggcgcgcgccactgcatttaacgctgaaaccggcgtattgacccgccagtcggacgccaccgctaacgccaagagccattcgcaggcggtgcagtgggtagtcaatggtgatctcgattggggtttcactcatcaccaactgatgtttggtatcgattatgaagcccgccgcgttttccgtggcgacatgatacgcggcagcaaaaacaacgggtttaatgtctatgacccaatttatggcactctgcccccatccacagccgtcagtgctgctgatagcgatcagcgggaaaatatcgatagccgcgcgctgttcattcaagactcgatgcgcctaaacgagcactggctattgctcggtggcttgcgctacgacagcttcgatgtgatggccggtaaaggccgcccattcaaaaagaataccgacagttccgatagccgcttggtgccgcgcgccggggtggtttacaacctgaacgactggtcaagcctatacgtcagctacaccgagtcctttaaaccgaatgtctctatcgccaccgccattgatgcgttaccccccgaatacggtaaatcgtgggaggcgggctacaaaattgatatcaacaaccgtgtaaccggtacgctcgcggtctacgatatccataaacgtaacattatggtcagcgagctggtagacggcgaaacagtcacacgtaccgccggtaaggcgcgttcacgcggcctggaactggatatggctggcaaagtgaccgactcactgagtctcattggcagctatgcctataccgatgcacgcctgactgaagacccggataacaatggtaacgacctacccaacgtggcacgccacactgcggcactgtttctgagccgggacttcggcagtacgtcattgatttcaggcgatgaagtgaaagcaggtattggcgcacgctatgtcgggaaacgtgctggcgacgccgccaacagtttctggctagataactacaccgtagcggacgcgtttgtcgcctggaagatgccgctctccggctatcaactcaaatggcagcttaatgtgaaaaacctgttcgataagacgtactatccgtcgagcgctaacaacctgcgtatcgctatcggcgaaccacgtcaggttgtgttgcagggcagtatcgatttctaacaaacagagggcattgttactgaagagggtaatgttactgcagagggtaatgttactgcagagggtaatgttactgcagagggtaatgttactacagagggtaatgttactgcagagggtaatgttactgcagagggtaatgttactacagagggtaatgttactacagagggtaatgttactacagagggtaatgttactacagagggcattgttactgctgccctctgtttagatcaacgtcctgacctagccccaaaaatcaggctttactccgcgattttaggctttggaccatcaccgcgatgatgatgataacccctttgaccacctgttggttatagccggaaatattcattaaattcattagattggatattatactcaggataaatacgccaataatagtattgaccacattgccatggcctcccgccagactggccccgccaacgactaccgccgcaatgacatccagttcaaatccaatagacagcaccggtgatcccacccccgttcgggtggcagaaatgatacccgccgcaccacaggcaaatgcgctaatagcataaacggctaacttatagttattgacccgaatacctgcgaagcgagtcgcagtttcgttagagcctatcgacaccaccaaccgaccaaagaccgaatttttgtataccaattggcaaataatggcaaaaccgaggaaaacatagacaggcagagggatcccaaggaaatagcccgtaccaaagtttacgaaagcatcgttatcaataaataccggttggcccttagaaataatcagcgccacgcctcgcgcaatggtcatcatcgccaatgtggcaataaaaggcgcgatattaaaccaagtgaccaaaaaaccggagaatgcccccatcaaagtggcaataccgacacccgcaatcaacgctggccataacccaaattctgggatcaacagccctaccaagaccgagacaaatgccataatggagccaatggacagatcaataccaccagtcagaatgacgaacaacatccccaatgccgccagaccgagcggaacactttggcgcaacacattggtaatattatccccactgtaaaatcgatcagagaagaaacctgctgcaatcaacataacaataaaaacaacggtcgttgagttgtctagcaggaacagcgccgttctcttcatcaatgacacctgcctgacgtcatcaacctctttgactatggatcccattaccttatcctttatgtaatattgtcttgatgtcatattgtctcgcgcttgggaatggcatagcgcatgatattttcttctgaaatctcatcgtgttgcagctctttggtaatgcgcccttcactcatcacataaatgcgatgacaaagattaatcacttcaaccatctccgatgagatcactaaaatggaataaccgcgttcggccaattggtgaatgatgttataaatttcagccttggctcccacatcaacaccgcgggtaggttcatccaagatcaaaatatggcaatccgtgttcaaccatttagcgatgactactttttgctgattaccaccacttaagctggcgatgggatcctcaaccgaccccagtttgatggccagtttttgttgtagcttctggctggtctctcgctcctgacgacgacgaataaaacccatccagccgctaaccgccttcagattcgataacgtcatattttcgcggattgggcgtaccaaaatcgccccctgctccttacggctttcaggcaccagaccaatcccatgggacatcgcctgtgacgggtgattaatctgaataggcgtaccggccttggacaccgttccccccgctatcttgtcaatgccaaagagacaacgtgcgacctcgctacgccctgccccgaccaagcccgctaaaccgacgatctcgcctttatgcaatgtcagattaatatcatgcagcagcgcacgggttgagagggctttgacctccaagaccacctcattacctggcacatttttctcgggatagaggctttccagtttgcgccctaccatgctggtgataatttcgtcttcgctacaggactggggatctaaggtcttgacggtctcgccatctttaatgacggtgatcacatcagcaataaccatcaattcttccagccgatgtgaaatataaatgatggtcaccccgcgtgcctttaacttgcgtagctgggtaaacaatatcgcgacctctttacctgacagtactgctgaaggttcatcaaggatcagaatgttgacatctttggccagcgacttagcgatttcgaccatctgttgataggcaacactcagatcccccactctggcgcggggatcgatttgaaatcccagttcattcaggatgaggctggctttttcattcaaacgcttccagttgatcatgccggtgccaaaaccaagatcgtcgagaaaaatattctctgctaccgtcagatccggcgataacgccagttcctgataaataatgccaatacggctttctttactgtggatcggtgaagtaaagtttttctcctctccgtggatcataatgcgcccgctgtctttggtgtaaatccccgacaggatcttcattaatgtcgatttcccggcaccattctcgccgataatggcatgaatgctaccggtgcgaatttgcagattaattgacttcagcgcgtgaatccccccgaagcttttcgtcacctgtatgacttcaatagcgtactgatccacctggtcggtctcccatatccccctgtaaacagggggaaacgacggttagaaaatcgaatcttctttataatatttgtcgacgttatctttcgtgatcagaatggaggggatatagacataatcaggaaaactcgtctgaccggcctgatattgaccaataacctctagcaccgtgcgagtcagcaagtctgggttattcgaggccgtcgcttgcagttcgccttttttcacggcttccagcccctttttatacccgtcgtgagcatacactttgacattatccagcttgttagccgctttcagcgcacggatggcacctaacgccatatcgtccatttcactgtaaacacagttaattttatcgccctgcgccacaataatatcttccatagctttcaaaccgccctgctgatcccaattcccccatccttggctaagaaagttcacattagtgcggttgtatttacgtaactgcgcttcagcaacccccagcaggaagttgtcacggcgcgcctggccgaccaaattaccttggttaccactgagaaatatgcagttcatcggtatgtcgccaaactggcccaccgcatattcgccgatcaggttgttatttttggcattattggcctgaactcgcgtgataaccggagcttcaagtgcgatatcgctatcgaggatcacagtaggtacaccagcccgcttggcaatttcagtaatgcgcaaacccgcttggggatcttgcggattgagtatcagataattaatcccctgtgacagcatgtcctccacatcagcaatttgcttattcaaatcgccgcgggcatcggtggtaattaatgtatagcctttctccttagcatgaatcttcatgtattcggtcagcccattaaagaaagcgccattcaaggtacggttagcgaagccgatcttgagtggctctgcggcagaggcactcattgagatggtgacaccggccaacagcaggccaattagtctctttttcattatatttcctctcgttatacagggcgggtaagggttgttatcagactaaattcggcagattgactgactacggccgttatttcaaaaacgggtgctgttacctgaacgggcactctcaatttctcatcattaccgattggtcatttgcccacaagaagggcttttgacttatttttaggttacatgaataattgctctcagttattgctttaattcacaaaaataaaacaatctttattcgtgaattaacgaattgattttattaattaatttaattcatttattgctattagccattcaataaacaaaatgctgccaattagcatgatctacataacagaaataggagaggtgtttccctgatgagtgaggggtaggcgatgtaagagagaagtggtgtaaaagatcaaagcgagatgccgcaacgctggtagcatgcgatgagtggcaagcctaggcgctagaaatgaacgatggcgttatcaggcggggcgaatgagatgtttaataccaaggccatcaattaaaaaatggcctcggctgatggaacggagcaatatcagactattgcgtaatcacataaccaaagatacgccgccaagacacatcacctttttcgatataaacgccctgtaactcaggtgaaaagcccggcagtaagttaatcccctcttccagcgccagaaaataacgctgaaccgccccaccccacacttcaccgggcaccacacacagcacacccggtggataaggcaaagcgccttcggcggcaatacggccttcagcttcagcaataggaatcaactcaatattatcgcggataaactgaatattggcgtcttgcgggttcatgactacccgcgggaaactggctttacggaacatatccttttgcaattgcttaacgtcatggctgacgtacaggtcatgcatttcttggcataactgacgcaaggtataaccgtgataacgctcttcattcttacgatagatcgtcggtaatacatcacacagcttcgcatcttgttcaacatagcgttcaaactgcaccaacatatccaccaggtgtgccattttggcggtattttctgccggggtcagcaggaataggatcgagttaagatcacatttttctggcacaatcccattttcacgcaggaaagtcgccaaaatagccgccggaataccaaacgaagtatatcggccagtgctggcatcaattcccggcgtcgtcagcaataatttgcacggatcaaccaaatactgatcttggttatatccctcaaatccatgccagcgttcatctgggacaaaattaaagaagcgcgcatcattggcaatcacatcagtagcataatcttgccaatttttaccgccaacaactggaggaataaaaggccgtaacatcgaacagcgtgccaataacgatttacgggtttcaataccgagttttacacaatccatccacatacggcggccactgtcaccagagtgtattttggcattaacatccaatgccgcaaataatggataaaacggactggtcgatgcatgcaacataaaggcattattaaaacgcttatggttacagtgacgtttctgtcctttaatgtgattatcttttttatgtacctgagaggtctgagaaaaaccggcctgctgcttgtgtaccgattgagtcacaataatcccagggtcattttcatttaattccagtaataacggtgagaaatccttcatcatcggaataaattgttcgtaacccacccaagcagaatcaaacaaaatgtaatcgcataaatgaccaatactatcaactacttggcgggcgttatataccgtaccgtcgtaggtacccaattgaatgatcgctaatcggaatggccgagcctcttctgcacgctcgggagcaacttcacgcagttgttgacgtaaataatcttcattgaagcagtgcgcatcaataccaccaataaaaccaaaggggttacgagccgtttccagataaaccggcgtcgcgcccgcctggatcagcgcaccatgatggttagatttatggttattgcggtcaaacaacactaaatcaccacgggtcagtagagcgttggtcacgaccttgttggccgccgaggtcccgttcaggacaaaataggttttatcggcattgaataccttagcagcatatttctgtgcatcttttgccgccccttcatggataagtaaatcacctaatttgacatcggcattacacatatctgaacgaaaaatcgtctcaccgtagaattcaaaaaactggcgtcctgcaggatgcttgcgaaaaaattcgcccccttgatggccagggcaagcaaaggtcgagttattcatctcgacatattttttcagtgttgagaaaaaaggcggtaagagattcttttgatattcactggcggcagcttctacctgagcgttataaaaagctttatttgcttcaccaagcgtaatgacacctttaatcaagggcaaataatcagcagagaccgtctgttctgccgtcacggcaataaacgcaggaatagcaaaaccaaggtcatgcagcattgacaatatacccgcatttgcatcttcaaccgacattaccaccgcggcaacatcagtaaaatcagtctgattgaggtacaccactccgcgctgagtttctacataagaagccaggcgggcgcttgttgctatttttaatagtgtcatatcacttactctcagacggtcaggtatgaggctgccattttggcatatcgatgacatcacagagtgcggagcactgatgcaatgccggtaaattgatgtcattaaatgcgcacgtttccccggcggaaatacacgcctgagtgataggtgaactggtctcagcatcgaccaatagacatcagtaaaatcagagactctgctctatttttaataatgcctaacagtgagcaaaaggttgccttaccgcatggaaaaaataaggggcttagtagaaataaagcagaaaagaggacatgtgaggcgctcaatatgcatggaattgtgtaaaactgccataaccgcctcctacctgaatactcgaaatgatatgaactagagacatgaattgtaatgctaaaatttgcgcaatagttgcatgttttgcctgagtgttcaacccttgacagccaataaaaatgcatatttagtgaatatctaagccattgttatttaacgagctagaaaaataaaaatctataaatcaaccagatgaaacatttagctgcgttccataaataggcaagattatatcgctttaacgttcattgtttgaaaagagagcagttgatcgcctttatatgagaaactcattgacgatttggtgctaatacggtttaatgcgccccgttgcccggatagctcagtcggtagagcaggggattgaaaatccccgtgtccttggttcgattccgagtccgggcaccattattcaaaacctgttcgttaaggataaatattcttaacgggcatgaaaaagtacccggatcatcatcgtgcaagtaggctgcaattactacaccttggttgaacatacgggacgaagaaaccggaggatgtcgatgacaaacttcggttttcttgtgtcttaaggcggaggatattgacagtttttcagcgctcctgtcaatatcctgttaaggaaagcggtagttttttctttctgttatgccgatttttttaaaaaacctcttttctctcgaaagtctcttccaacgccaatctgaggctgtctatatcgccctcaacatattccaacgtgaccgcaatacttgaatgccctagcagggtctgaaccactttcagattacgatccggtgatttcatcatctcagtggcgatagtgtgtcgaaatcggtgtggactaatcgtacaacggcattcgactgaaagcctgcggaagaaagaacgtaacgggggactgtccatattttcagtgacggtctcttttctcccgtcaatccggctgatgttgaataactgatccactacatcattgattaatcctttaattaagaaaatggatacttctgagtgggtggtttagctttagcggctaaggctggaaattcagttgggagcttggccttatctaaccgcccgtaataccctgctttggtcaaatattcccccgccgttcctgactcgatccgattctcatccagcgtgatataactgcctcccgcattcagcgtgatcttcttcttggcggtgatttttatctcatcctcggtgctggtgatcgtgatcgctttacgcgccaataactccattagatcattctgggcctggactgttatcgacccctgattggctattagtttcatccccagctttctgacgaagatacttagggtattgcctacgccgataaagaagtttttcgcgacgctgacgtcggtatttttaccggcggtggcaatcaggttatcgctggcactcatttgcagatgctccccgctgctcaacgcgatcccctttggcgcactcagtaacaggacagcttgtttcagttcagtgaggttttgctgcaacagactgatttgggcctgtaaatcagatggatctgctgtggctgtttgtgcgtcagtggaaatgccctgcatctgttcctgcgcacttttcaacaggctgatagccggttgtatctccagtaccttatatttaagtaagatattttttaatttagctgttaattttacaaattatttccaaactctatacttctccatctctaacctcttccaacattaatcactaatatattcatgacacttcaaaccgcatgtgcgctggctatatttaacatcaaaaaccaataaatattaaatttagtgtcattcctatttattattctgtaaaaaatatcaatctaattcaatattaattaactttcactttgtaggttttttttcaaatccgtgccctacactagctaccactcctcctttaatatttataactattgcagcgttagtgttaggaatttcttatacaacaaattattatataaatagtttgtgtaatgatttttcctttaaattttaaagccaagacagaatttattggagtaatttcataagttaagtcaaccaccggcccagcaccaccaattatatttacctctgctcagtacggagttccaaatttagcatccgccaattcactcggttcaaaagttatagttgacacgcacccactgacaaacaccataaaaataaaaattcggtcatgtattcaatctggttattagcatcacactaggtaatgctcacgctcaatgaacgtaccgatgattctgtcatgcatttctgccgactttgagtctccgagagtcttgcggttcagtcgtttcaaccgattacggatattcaggttttcacgctcaatccgctgcgtgtaaagcttgctcctgatgtgtttttcatccggcaacatctcataagcactgaagttgtcggtacaccagaagacgatattgaaacctgacagcaaccccaataattggcgaaatgtctttttgctccgacgaccaaaaacatgagcaataatacgtttgaggcgaggctcccaggcataccaaagccaacgttgctgctttttgttgcccacaaatgaccacatttcatcgacttcacagataagctgaatttgcaggttatccagtgggagcgtggttacacgctgcggcgagagttttttaaagtgcgcatgaccgcattgatactgatatgcaacgcccgtgcagtatcacgaataccggcattgttcatagcaagatcgacaatttgctctttcataccggggtagcaggcacgatactcgtactctagttgaaagctccgtcggcaggcctgacagcggtagcgctgatgccctgtgcgtcctggcccgtgctttttaacagggtggaactgctcgcaaaatggacatttcacatcaaccttagccatcaaaccctctcagataaatacgaggattttacctgatgatctccgcattgaatgcatgaccagtttttttgaagttatacaacttaaggaggcccttattttgagactaactcccctccaagttcttctagactggccacaccgttgaaaagtttatgacatttttcatctatagtgatgctgctatttttatgtgatgagaatacaactctttttttgttttcgagatcccagaccccagggaatgagtcagaggaacagtccagattgacagggaagatatacttcccatttatggatattttaccaccgtatccgccgcttgatccttctaaataaaatgaattatctttattagttgtctgtttattttcaaaccctttggcattaattatatttttattgctatcgaatttagacacgatggcagtataactcaaggtccttatatcttctaatactacagaaagatagatttttttatcaaagtttaaatctattacggtgccaaatgggggtgagtttggaacggggactttgtgtaatgaaactcccccttccttgcaattaattacttcatctacgtaaagatatgcctgtgtattggccaaaaggatggccttcttatccgttgttagtgatatgacacccgcgccattgttgtactttatattccaatttttaattacacattgaatgtcagtgtggtttttttttacatgcaaaattgcattttcatttttgtctaataaaacgatgtaatcatcaaatgacacttcattataatacgtagcatgtgctaagtggggtgtaaaaaataaaatataaaaatatttcaatgtcaattttttaatatttatcatttaattttccctttgcgttattagtcattacttttctttgtgacagcccaatgtcaccaccattaatcgcttgagtgacctttgtcactacactgtcatcggcactttctgcttgatctttatcaatttcttttactgtactacgtctaaaacaagtaataaaaaaagaaccagaatcaatacagttatatggtgaggccgtgattttgtgaggatcatctataatcgcggggcgttttttcatcgccttaaggttttttgatttatactttacatcgtcccaccagtatgcatcaaaagaacttttcaatagccatcctcgataaacccaataatctgcatatttatctctaccggttaacattttaaaaccacgcccacgaaatttctgagcatcaacatccccgcagtttccgttactccagctatatgacccagcaattaatccgccatttttattgtacttatttcctgagtaatatatatctaattcactgggttcagaaccgtaccaatgtcccaactcggactcattcaaagttgattttataacaatgccgccaccagtttgtttgccatttacaatcacctgctcctggctaacctcttgcatggctgttagtgaatcagattcgacggccccctgcccaagaaaatgactttgtctattcggtgttaatatattatatttgcgcattgctaaatttaaaaatgtgtagttactatcactggctttctcgattaaagttatttttcttacattgcgttttttatttaatgctgatgtcaggatggattttattttttccggatctaaccacccgcacttcctaaaatgtgcaataaacgaaatagggttaaagtgccagacccgccctgcaggcaaaccgctgacatcaaaacacaatgctttagcatgttcgataagcgcattccagtcggcttctgccatcgcggtatcttttgctgcttgttcaaaagagggagtactttgcgcattcagcacgctcatgtcagggtttatattatcgaatgcataccctgaagcattattccctgtgtcatctacctgatggcttgctttttgattggccagactttcatttatcaccgtcgttttcagccatgagagacgtttctctagcgtcgatgcgtcccattccagtggtaaatggcagatcagaccctgcatatcatcgccaatacggcagagtacctgctctgaattgcactggctgttttcgtctgtgtcgtcatcgatcagttgccagccagtccagtgcgggaaatcaccatcactgaacttcttcactgccggaagggctaggttcacaacgcctttgccacccggataactgatggttcgccacaatggtgcgtcggcagggaccaatgtttcatagtcggtgttgatgacccgaccaaaccttaacagctcataacctgcactttggctttgcgggtataacttcttagcctgcgcatacaagttgtattcgtaatctgcaccatcggcgttttccagtttttcaccgacctcgctgtattttccaatagagaacacacctttcttacgtgtgagcatggtgcacttgcccttatcaaaactcatgctgacaaagagaggttcggtgctggtataggtttcagcttcggtggttgtagtggcattgttggccggcgcgtggctgtaaaatttggtgcctgttggcagataaaaatacatatcgccataaaccgcatccgttcggccatttttcgtcaaatccagttctggcgtcgtgcggccaactaattttgtcaaattagtgtcatcacaaaatatctggaaatggactgcattgcctccatcaacctgaccgacggtaccaatgggatctttgcgataaatcttctcgccagtttttactgctgcatctatagaggccaaatgcatataaagcgagaaatacactactttggcattttcacctgaaccgatctctgtttcatgtttcaacaaaacatagccgcaatccgtagcgccattgtagttataaggaggaatgccttttttatcaccgactggctggcggagagagtgcaccgtgccatctgcgatagctcggatcttttctggcgtaccgccgctgtcagtatgaggaatatgtatgcctccgtgccacgagcgatggctgttaaggggaaaaccgcgctcaggatctacaggcatcattctggagacccaggaagcatcgtcttctgagttggacttatcttttaaaaataaagggctgataatcatattttaacgtcctgttaagagaatagccaacgtttaatggggtcttcagttttagcggctaaggctggaaattcagttgggagtttggccttatctaaccgcccgtaataccctgctttggtcaaatattcccccgccgttcctgactcgatccgattctcatccagtgtgatataactgccgcctgcatttagcgttatcttcttcttggcggtgatttttatctcatcctcggtgctggtgatcgtgatcgctttacgcgccaataactccatcagatcattctgggcctggactgttatcgacccctgattggctattagtttcatccccagctttctgacgaagatacttagggtattgcctacgccgataaagaagtttttcgcgacgctgacgtcggtatttttacctgcggtggcaatcaggttatcgctggtactcatttgcagatgctccccgctgctcaacgcgatcccctttggcgcactcagtaacaggacagcttgtttcagttcagtgaggttttgctgcaacagactgatttaggcctgtaaatcagatggatctgctgtggctgtttgtgcgtcagtggaaatgccctgcatctgttcctgcgcacttttcaacatgctgatagccggttgcatctccagcaccttatatttaagtaagatattttttaatttagctgttaattttacaaattatctccaaactctatacttctccatctctaacctcttccaacattaatcactaatatattcacgacacttcaaaccgcatgtgcgctggctatatttaacatcaaaaaccaataaatattaaatttagtgtcattgctatttattattctgtaaaaaatatcaatctaattcaatattaattaactttcactttgtaggttttttttcaaatccgtgccctccactagctaccactcctcctttaatatttataactattgtagcgttagtattaggaattccttctacaaaaaaattattatataaatagtttgtgtaatgatttctcctttaaattttaaagccaagacagaatttattggagtaatttcataagttaagtcaaccaccggcccagcaccaccaattatatttacctctgctcagtacggagttccaaatttagcatccgccaattcactcggttcaaaagttatagttgacacgcacccactgacaaacaccataaaaataaaaattcggtcatgtattcaatctggttattagtatcaaaccaagtaaggctcacgctcaatccgctgcgtgtaaagcttgctcctgatgtgtttttcatccggcaacatctcataagcactgaagttgtcggtacaccagaagacgatattgaaacctgacagcaaccccaataattggcgaaatgtcttttgctccgacgaccaaaaatatgagcaataatacgtttgaggcgaggctcccaggcataccaaagccaacgttgctgctttttgttgcccacaaatgaccacatttcatcgacttcacagataagctgaatttgcaggttatccagtgggagcgtggttacacgctgcggtgagagttttttaaagtgcgcatgaccgcattgatactgatatgcaacgcccgtgcagtatcacgaataccggcattgttcatagcaagatcgacaatttgctctttcataccggggtggcaggcacgatactcgtactctagttgaaagctccgtcggcaggcctgacagcggtagcgctgatgccctgtgcgtcctggcccgtgctttttaacagggtggaactgctcgcaaaatggacatttcacatcaaccttagccatcaaaccctctcagataaatgcgaggattttacctgatgatctcggcattgaatgcatgacccaaattatgcaactttctcttaatttctatttctggctttggcttctccttgccaaatttgtatatgagagtatcactatcttgatagattgatattgttttattatttgaagctgagtatttaaacaccagatcctgtgcgtgaacgttaatggccagcattcctcaaaaaatgattgaaaatgattgaaaatgattgaaaatcatattaatttattcgattccctctcccaagttaattttattcaggggttcaagcacaaaatcacgattataattcggaagtattttcgctttagattaatttttcgtgaaatcccctcagggtatatgcatcatcttaccttgaatgaaagatatatgctcttgtaataattaaataaggacggatcgcctctaccagtaaaaatgaaatttatcttttttggtaaatttatttctgcctgaaaacactgttcagaatggtatccagcatcatcttcatacttgcacgaaattactgcactcatcccggtaaatttcgacgtgacatttatatctgccaaaactgggatgccatcagttactgcctcccattctccgcgatcattcattgtgaaataatcactttcctcactttcctcactttcctcacttgaggaatttctgcatagcttaaggtaatcggatgcatttacatgctcagccctcataattaaacaatcattttttttgttgactttccattttacaggaatatttatagcagcctctcccagaggggttgatttatgctcttccccgctataacatgaattcgcaaacaaaatcaaaaaaaacatcataatagttttcatttactcatcaccaacaatagaatatgtattttgcgttgattgaaatctgcgctcaaaagattgctgatcccatctgtttattaccatgctaacagatcttgaactatcgcgtgtaacccctgcatctgctcttcgtaaaactccattttttgctacgaattgccctccagagtcaatacaattatacggttctgtcgatatattttgagggttatcgattaaaggaacccttaaccgattgggatttcgccaccaactattatcataatccgtactacgcaaccatcctctataagtccaatatcccgtgtaattcgctaggccggttaactgtttaaatcctcgccctcgaaatttcatcccatctccaatatgagataaatttgaatcaatagttctcctttgaggcgcagttaaaatcggcctattatttgagtcccttccgataactacagtcaaaagattatttcttgaatctcttaaatcgcttttagtgatattccccaaatcattaccttcacgctcataattgtggaaataaccataaatatctgtcgggtcagcataatagccattaatttcttcggcaaatgatggatgatcaggatgacggctaaatgaaacagagccctcaaccataagatttaagttttgtgattcaattgcaccctgccccaagaaatgagctgtgcgtattggattattcatgccatatttaattaatataaaatttatagaagtacgatatttttccctaacatctttagctgtagtggagtaaaccctacttaaatctatctcatctaaccatctacttttcctaaaattctcaataaacccacgcggatcaaaatgccatactttccctgaccccaaggcccctgaatcaaagcatagggcttctgcatgctgtttaaacctaccgtagtcttcttcgttcatcagaattcgatccttcgattcctgagatcccggtatttgccatgttgcggttttttccggcgtgcactgctcccaaggcagaccagtcatcagccatttatatcgggtatcaatagtacttttttcccactcaaacggaatacagcagataagtttgctgctttgtgctgcatacctgtctttttccctgagctttcttattgccgctgagttgcactggctatgcatgtctttatcatcatcaatcagctgccatcccgtccagtggggaaaatctgcatcgctgaactttttaacagttgctacggctaggttcacaacaccttgtccaccgggataatttacggtcatccataagggggcatcagcaggaaccagggtttcatgttcagtgttgataatgcgcccaaagcgcagcagttcatacccggcactcggactttgcggatagcgtgaggtggctgttttataaaggttgtattcatagtccttgccgtcggcattgaccagaggtgagccaacaggctcaaaggcaccttctgcattcgcacatgcctgtcgcgtaatcatcgtgcctgcccctttactgagactcatgcttgcgtacaacggaaccgcactggtatgcacttcattcaagttcgttgtggtagctatattagccgaaggccgcgcctcataaaatttcgttcctgcaggcagataaaaatgaatatcgccatagacaacatctttccggccactttcattaatatttaactcgccagtagttctaccgaccaatttcctggtatttgcctcatcacagaaaatctggaaatgaaattcattctgcccatcagtcattcccgaagaacccagcggggctttacgatagattttagcgtcagttttaatctctgcttcaagatgtttgaggtgcatatacaaagagtaaaaaacaaccttcccgtcgtcaccggaaccgatttcagtctcatgtttcaataaaacataaccatcatccgttcctctgagaggcgaatacttcagcgggaattgatctctttcccagggttttgaaggcattcgaaacgacacaaccgtaccgtcagctattgccctgaccttctcaggcaatgcgcctgagtccgtatgcggtatatgtatcccgccatgccatgaatccgacgtattaagaggatatcctctgcgggaactgacaggcatcatcgcgtcaacccagtcagcatctgactgggttgcatctctatctctcagaaatggaggactgataatcatgttgtgactccttgtcaggaaaaagtgaaatgactggtgggttctgttgtttccggggcaacactcggaaaatcttctggtttatttgccttttcctgtcgcccgtaataccctgctttggtcaaatattcccccgccgttcctgactcgatccgattctcatccagcgtgatataactgccgcctgcatttagcgttatcttcttcttggcggtgatttttatctcatcctcggtgctggtgatcgtgatcgctttacgcgccaataactccatcagatcattctgggcctgtaccgttattgctccctgattcgctatcaactttatccccagcttgcgtacaaatatgctcagcgtgttgcccacaccgataaaaaaattcttacctacactgacatccgcattcttaccggcagtggctatcagattttcgctggccgacagttgtaaatgttcgccactgctcaacgcgatcccctttggcgcactcagtaacaggacagcttgtttcagttcagtgagattttgctgcaacagactgatttgtacctgtaggttggccggactggcggtggcggtttgtgcatccgcggagatggcctccatctgttcctgcgcacttttcaacaggctgatagccggttgcatctccagcacctgcccctgtgctttggcctggccgtcggcagtgataaaaatgcccttttctgcccgcaaggcaccaaaactgtcggtgcgcagctcaaaaccctcaccccgagactgtttctcgttatcgaccagatgccccagattcaactggcttttgccgccgtattcggtgctgagcttgatgtgctctttgccccgttcatcctccaggcgcagtttgttgttcgacggagtgcgcagtacgttgcgtttgtagttgctgatggtgacgtggtcgccgtgcgccgagtcgtgcagcacataggcgatatacggccggtccgggttgccgtcctcaaatgcaatcgccacttcggtgccggccagcagcggcaggtgcaggccgtaggtgtcacccgcatacggtcgagcctgacgaacccacaagctttcgtaacccgactcccaactgtcacggtcgaacatcaggttgacacggtagcgcccgtctttgtcgatatgaccataagtgtcgttcgcagtggtactggtcacccgcgccggcaaggtcccggccatggtcggcttgcggatcagcgccggacggaagcaatactcttcggaataaggaatggcttcaaaatgcacttcatagctgcggtcgcggcgggcgtggctggtgatgcgggtgactatcacccctttgccaaattgtgctggcacgtcgttgccggtgactttcagttcctgacccggtgacagtgccgccgcattggccaccccggcgaagcgcgcctgattattgaggtaacgttcatggcgcaggcgggcataaaaggccccgctttcactttccggctcgcgcccttcgctgcctacgatcaggtagttatcggcgtaatgataggcttcgccgtaggtggtggtatcgccgcgagtgatatcggctccggccgtcatatcggcagtggcggtgcggtagttgtaatcaccggtactgaccgatttctccaccacctgatgggcactggacaaatcccagaccgactccgtcccgctgtcgtgcaggcccgaagggggcactgcctgtagcgtcagccctgacgggtaaaagcgctggtcgtcgtaaaactccaccacatcaatattgagtttgggatcggcggtaaaacgaaaccagatccccacttccgccagcaggcggcggataaaggtcaggtcatcttcgccgtactgcatcacctgctcgcggcgcgggtactcgcgggccagggtgaagacaaaatcctgaccgcgcatatcatggcgctcacgcagaattttttccacaatctgcggcaccgacatgtcctgatatatcccgttctgatggctgcgcgacagcaaggccaggcgcggttgcaggctcagttcgtagcggcattcctctttcgaggccgacaggcgtttaaatccggtgaccaccccttggatcactcgctgggtctgctgaaccgtcacgccaaaagcttcggccaccggggccgccaatgtcagtgacgcgtcctgcatcagcatggtggccgggtcaatcgccttgtcggcgctggtgaattggatgtcgtaacagaacggctggctcaggctttcgtggccttcaaagcccaacacatcaacggcggcggtgctgtcgcggaccaccagtttgtggtggctatggtcaaaccgaagagtcgggagagtggtattcatttttcgcctccttcaaattcaagggtaatgccgtcggcttcatcccagcccagcgtcagcgaggtggtgcgctgttgctcgctcatgcggcttaacagctgctggctcaataccggtaaaatctgctgattgagcaggctgtcgatgttgcgtgcgccggtgtccggcagcaggcaggcggcgaccagtgtgtcgtacaggcttgcttcaagagtgcagtgcaggccgtaatgttttttgaggcggttagcgacctgtgccagtttcatttcgacgatggtgcgcagcgcgggggcattcagtgggcggtagatcagcgtctggaagcgggccagcagcgcgggctggaagtggtcgcgcaatattggccgcagcagttcatgcagggtgctgtccggcgcgtccggttgctcatcgagcaactgcatcagatgatcactgcccagattggcggtcatcaccatcaccgtgttgcggaaatcaatttcgcgcccttcaccgtcgcgcataaaaccgcggtcaaacacctgatagaacaggttcagcacatcacgatgggccttctcgacttcatccagcagcaccacgctgtaaggccgtttgcgcaccgcttcggtcaatacgccgccctgtccgtaaccgacatagcccggtggcgaccctttcaattgggagacggtgtgtgcttcctgatactccgataagttgatggtgatcagcgatttctcgccgccgaacaggctgtcggccagtgccagcgcggtttcggttttgccgatcccactcggcccgaccagcaggaacacccccagcggaccattctctgatgtcaggccggttttcgccgcccgcagccgttgcgccagcgcgcctaatgccgcatcctgcccaattactcgctcgcccagacgattttccagtgacagcaagttggtttgttcgtctttgagtaaactgcccagcggcacaccggtccagtcggcgatcacagccgcaacagtgcgcacatcaacgtccagcgacagcagcggcgcgttgccttggatctgaacgagttcctcctgcaacgcgaccagatgtgccacgttggcgatatcctgacgcgcctcgataatcagggtggtcagccgtttttcttctttatattgctgttcgagtgtgtgctgcccaaccgccagcgcggcgcggcgttgctcaatctcaggtaagcgcgttgaactgacattcggcagcaggagcaagtcctgttcgatggcctgttgctccatcgccagtgcggccagctcggcgttaatcgccatcagcgcagtcggcaaggtgtcaatgctcatgcgcacccgggcaccggcggtatcgagcagatccaccgctttgtccggcagttggcggccggtcaggaagcggcgcgacagggtaaccgctgcggtgatagcggcgtccagaatatgcacgccgtgatgggtggcgtaacgttctttcaggccacgcagcatcaggcaggcggtgtcatcatccggctcgtccactttgaccatctggaagcggcgctccagtgcggcatcgcgttcaaaatactgtttgtattcggaccaggtggtggcggcgatggtgcgcagttcgccacgcgccagtgccggtttcagcaggttagccgcatcggcaccaccggcctgattaccggccccgataatggtgtgggcttcgtcgataaacagcagcaccgggctgggggattgttgtaccgcctcgataacatttttcaggcgctgttcgaattcgcctttgaccccagccccggcctgtaacagacccaaatccagtgtgcgcacactgacggttttcaggctgtccggtacgttgccgtcggcaatacgtagcgccagcccttcaaccagcgcggttttaccgacgcccggttcaccgaccagaatcgggttgtttttacggcggcgcgacaggatatcgatcatctggcggatttcgctgtcgcggccaaaaatcggatcaatctggttggcacgggctttagcggtgacatcgagggtaaatttatccagcgccgcttgcagcgcgtcattcagttgcggctgaccactggcggaggtaaccgtcgcggcctcatcggccagattgaccgggctgtcggccagtgccgcagcctgctgcacctcaggacgttcgtcggattggctgtccagcaacggcaacaagcggtgtagttgggtagtgctcaggctgagcaacggccaggcggcatcggcggccaataatgatggcgaatttatcagcgctgccattagatgaaccgagcgcaccgcatcagcattttcctgcaacgaggcatccagccaggcacttttgatcagttgctgtaacgcggcggacaactgaggtttgccctgtaccgtgcgcggcaaggtgtccagatgggacagtaatccctgccacaggctgtccatgtcccactcataacgccgggcaatcaccgtgatatcgccttcgccctgctccagcagttttaacaaccagtgttcgacagtgatctcggcatgggcgcgggtctgacacagggtggcagcaccggccagtgcctgtgcgcaatagggatttaagcggcgtaataagtgtgctgaatgcgttgtcattaagatcttccttgtttgcgaaacctttgcgataccggataagtaagccggtttcagttggcgttattgtcgcagtcagtttgcacacggacagcgcacagggcccggagcgtacacgtagtacgtgacggtgccgagcactgcccaggtgcaaaatggcaagtaaaatagccagatgaagctggcgtcgggcacgctaccgcccatagccatatcctgagtaaggaaaccaaggcccataaggtcatctgataaaatgtgtatgcgtttagctgaatactgatatgccgatgctcagctaaaaacacaaaaaagcaggcggcgaaccgcctacttgcggggttaccctaaataattcgtgttgcaggcaggcggcaacgtcgctaacgcacctgcagcgcgaagaatgacgggtcactatgcggtggcgcgctcattccaagaatcggaatgaatgatgttgccgtctttaaaggtccaggtgattttttcgtagcgcagttccaccagttccaggtggttgtgcttctctttcgccggatctttcacgtcgtgcattttcggcgcaactttaaccactttgacgttttccagtttggtgttgaaatattcaacttcctggccagcgtcatcaatgcggtaccatttgaactcggcggttttcagtgtctgaccggtggtcaccgctttgtacaggtacggggtcgacgcatcgatctctttggtgaaaacgaacggggtgtggatacgggtaccggtcagtttgccggtattgttatcggttgggatgtacaggttatggtcctgtgccacgatctcaatgctgccttcacggctttgcacatcaacagaacccttgatgtccgcaccgccgtcgtctttcagccacagataaactggaattgccatggtttacttctccatttcttgcgttgatacgtcactttcatcctgtgacgctgtttttacatccggcacctgacaggcatcagcctgtggtaccagactgatttcgacccggcggttgagcgcccgaccgtcgggagtatcgttgtcggcgatagggcgtgtggccccgtaaccttgcaccgcaaagcaggtcggcgagacgtcgctggttgacagcatccagtcgcgtaatgcttcggcgcgcttaagcgacagaatgtggttggcctgcgcatcgccggtgatgtcggtatgccccgccaccacgatcagccagccgggtttggctttgatgtcgatcagcgccgtgaccagcattttggtggaccccgcattcagcgtgaatttacccacatcgaacagtgacaggctgtcgagacgcacggttttcggcgccggtggcgcgggaggcggaggaggcggcgggatgtagcttttgatcgccgccaacagcggcgggcgcagccgctccccccgatataaccccaggcccagacgcagcggttcaccgttgcggtacccttcatcaagcagccccgcatcacggtgtaataccgccaccgcctgcgctttcggggaataatccgtcatcgccacgctgtggtactgacggatatcaaaggccacccggtgcaacagttgccggttctgccaggcgctgctgcacaacgccaccatcgccgccaacgtcagtaaggtgacaccatggcgcagtacccgacggcgtgacgacaccccgctgccgagaggaagcgctgaaaagacaaaatccggcagcggtaaggcgtcatgggcggcgggcggcggtggatgccaacccgccacctgtgtcagcgtggtatgcgccgccagccagtgctgccacagcgaggcaggcaccggatcggccagactggcaacctgctgttgaataatctgttgcggggcaagggggtcaacatccgcattgggtgcctgcaataccggcagcacctgtgcgttcagccagtcatgctggctgctgaacagcaccgcctgtttcagtcgttcagcctgtacggcacggctttccgcacgctgccagtcggccagagagcccggcgtcgagacggttgaccagagtgtcagcggcggtgtctgctgctgtgacagccagaccgtatcacgggcaaccgaggtggccaccgtgctgctcaggagcaagggaactggatggcggctatcgcggcgcagttgcatcagttgccagcgcagctcttgcagatcggcggccagcaggcgctcatcgcggcgttgctgcgggttcacgaccatcatcaccgccaactgagcggcccattccggccgttgccacagcagttgtcgggcaaactgccgcagggtgctgatatcatccacccgcagccagcagccctgtgcactctggtgtgaccgttcgcgaccaaaccatgacgccagaccatcaccacataccaacaccaccggtaagcgactgttttcaggcagaagaccgttttcagttgccaacccggcgaacagcggatcagaggatgcaccggccgcttgccgccctgcccgcgacccgcccaacatgcaaatcagcaccacccatgccagcatcagccagcgcccccacggggagagcggcagaaatgccagacacaagatgaccgccagcaaacccgcccagagccacaacccacgttgccaccaccgactcattacaccggctccggcagtaaggtggttaacagaccggacagccagtgatcaaggccccaccacaacagcgcgaccatcagcgcagccagcccgagccgtaccggccagtaacgcagccagatccccaaccggttgcgggaggcggcgcttgccaggatcccaccggatggcgcgacactgaacgccggtacctgcacgctcagttgatcgatcagttgctcccgttcagaagccgccggggaggcgtacccgccgaggaagcccaacattaatacccggtgaaaacaggtcagtaccgcgcgatccggcgcaggctcacgcaacacggcgcgcatccgctcgtaaagctggctaccggcatccagggtattgaaaaaatgcgcctgtaagggcgaatggcaccacacgaagtaggcatcatcctgtacaccgcgccctttcacagtttcatccagcagtgcacattgggcgtatcggatgtgctggcaactctgctcgctgtgaccggcgtctttcagcgcctgatggacacgttcaatgtccgccacacagcgctgccagaatgcctgcccttcgccctcggcacaggttaccccttgacgcaggctgatcacctgtagccaggtgtcctgcaacaggacgtcaatatccccgactggggggtgttcggttaggtgaggattcatgcgcgtagcaccgcaaacagctccagttggatctcacccagcgtaccgggtacatagaacacacaggcccccgtctccatcatctgcgtcgccgcagggtggctgagatcaagggagaagtactggttttccagccgcaacgggatggcggctgggacatggctcagcggacgcagtgggatcccgctcaacgcgacattcaccacgttaccgacctcatctggcgcaccggctttacacaactgcgggaactgagtctgcaattgggccgcgggcaacgaggaacggaccgacaggtagaaatcggccccttcgcgcagacgagggtcacgcagggtcgcgcgccactgattgatacgcggttcatgaaccagctcaatcgccaccacccgtgatgggaggctggcttccagcagaatattcagcagggcaaacaacgggggaaagacgcgggtcagttgttcatgctgataaaccgggatcgccgtcacttcgtgttcaagggagaacgtcagcaggctgcccgccagcctggccagttcctgatacaggcgctctggatgaacctgcggatagcgctgaaaattccccaataccggttcggcactgttaagggcattgagcagccagaacagcgacacatccgcgacagcaaaatcggccatccgtgcattgctctcccggcgcatccccatcagacgctgcaaacgcgcccgcagttgcaccatcaataactcaagctgttcgccacaccaggcactggcctgcaggctcagcatcggcggaataaagcccggatccagtgtccagcgaccttgcgcatcccgcagcaaacgcgccaccgggcagacctgataatcgccgttttcctgagtgtccagccgcagggtcagttggtggtacatcaccgcgacctgctttttgtcatcgccgaactgattttggacatcgcgccaggcctgacgatggcgtaccgggcgttcgccccgctcatccggctgcaggcagttaccgccattggcatacagttgtggtatcgccagcatcaccgtggcgtcgctggcctcggcgggcagactggctgccagcgtcagcgtgggcggcagcacatcagcacactcggtatccaccagcacaccgtcctgaaaacgcacatgcaaacgcgccgctttcaggcggccctgtgccaatgcatccaattcaaaagtggcctgaagcacgccccagggatgcatcacggccatttgcgcaatgcattcattggtccaggcctcccaggaagcctgttgttgaaattgttgcggagacaccaggatcccgcgagcccacagagggcgttcaattttcatcgtgtcgccgtttatgccttagcctttggcatttgggaaaccaatgacagattgacgtccatcccttccacctggaaatgcggcaccgcatacagcttgacgcggaagaagccggggttgtcttcgatatcttcgaccgtcactttggcatcacgcaggggatgggacgcctgcaaatcatcacccggatcagtcatttccgtcaccagcccgcgcacccagttgttcagctccagctccagcagacggcgatctttggtggtgccgatgttctcgcgctggatcagtttcagataatgggcaatgcgcgacagcaggaagatatacggcaaacgggcgttgatgcggctgttggccgtggcatccgcggtgtcatacagcgccggtttctgcgccgagttggccgagaagaagcacgagtaatcgcggtttttgtagtacgacagcgggataaagcccagattggcaaactcgaactcgcgggtttccgggatcatcacctctgacggaattttgacctgattaccggtacccagatcgtacaggtggattggcaggttggtgactgcaccaccggcttgtggcccacggatctgtacgcaccagccatttttaatgaagcttttcaccatgttggcagcaaaggcaaacgaagcgttggtccacagataacgctcatgatccggccctttcacctgctctacgtagttaaagctgcgcaccggcacggtatctggcccgtaaggcaaacgccccagcacgcgcggcatggtcaggccgatatagcgggaatcatccgagtcgcggaaagctttccatttgatgtattcagcgcggtcaaagtagttgccgatatctttgatggccgccacctcttccatgttctctttaccaaagaacgccggacccactgagccgataaacggcatatgggctgcagccgccactttggagatattgcgcaataaggcgatatcttgcgggctgcggtcgaactcgtagttggagatagccgcggcaatcggctcgccgccgggggtgtcgtattcctgaatataggtctgggcgtataaaccgctttgtgagatttccggggcatcttcaaaatcctgcaccagatgatctttactgatatccagcagctcgatgcgcacgttctggcggaaatcggtctgatcgatcagcgacttcacaccacgccaggtcgattccacccgctggaaatcggggtggtgcattaccgcgtccaactggcggctgatttggtcatccagtgcggcaatatggccgtccagcagggttttatccagtttttctactttcttcgccgactgcttcagcaggtctaaaaagacactgacggcggcggtaacgcgctcatcggtggtggcttccgccagcgcatcgttgttctggaacgcctcgataccggccagtgaggagaccgggctcaggttgattttttcaaacaaggcggcgtaaaccccttgtgccgcagggctattctttaatacggtcgtcgcagtaccctgcgcacggttttcctgtacagacatcagcatgttccttttcttctttctaatgacaagcagccaatcccgggattaaccctcttttggcgccagggccgccagttcagcgcgcagttcatcgctcaaggcatcgtctttgaggatattttccagctcacggcggaaggtggcgttgtccagcagattggatttaaggtctcgcagcaggttgcgcatggccagcaaggcacgcagttgcggaatttgacgggccacgttttctggctcgaaatctttcatgtcgttgaaggtcagggagacggctgtatcggtgttatccccggccagcgtgtccggtacagcgagtttcaggctcggttggaattcagccagcacactgttaaaattgtttttattgatattgagtttttcacgttcagacagcgggcgctgctcctgaccgttgctgtaatcgcccatcaccaacaacttcaaaggcagttcgactttcttttgagcgccacctgtatgcagatctaatttaatattaatgcgtgcttttggtatctcattttggaagcttgaagaggacatcgactttccttattaaggcaggaaatttaggaaatccaccacagagaaaatgaataaaaataatctacgttacccggcacagcattcaccacccacggattagctcagtgtgtataaagtaaagaaataatatttatcgataaccctatccattcattggatggcatgaaacagtctctgacaggtatttctcacacgcatgagcagagcaataaaataccggatggcgcagtctagaaacattattcgattaacgcaaatgcgttaaatgtaacagaatgcaaccaaattcaatttcaaaatacatagcatccatatgatttataagaagtttcttacgtgacaggtaataacacactgttattaaaggggtaattaaacaggattaaaaccaaatgaggaatttgggaagtggtttgtaggaatatacctacaatttacctgtaaatatttttctataaatgagatctaaaacgataatattgcctcgttggaaattagacaaatagaacacttattactttagtaaatcagtaaagcattactaacataaacatgattgttagataaatcagatcattgactaatacgagagtttaagttattgatgccaatgctgagttcattatcccgagcattaacacggctaataatgtagagaggtaataaattatcgggttcgattatgtaggtcaatacagtaaataatctcaatctaattgttttcaagaaaaacgaatatcagtgtcttttaatgcgtcatattttgcatttatcagacgtcatttcaatagacaaacgcctcccccagaccgttccgaaattaggtaaatttgagtagatacaaaaggtgatgataaaccgtggcaggattgagtggccgagtgagtatgggaagcaattaaaattacgaagaatgcacacttattggatgttggcgtagggctgcaacacagtggcttgccgcctgggacttgtcccaatgaccccagtttttgaggcgttcactcgcatgcggccatcgtatctatctatctatctatctatctgaaggctttcagaaccagcgcaaaaggaacgtcttccttcctactatttttttctcttcatttttatttccttatcacgatgtggtgacattcccagtattcatgttgtaaaacacaatgtggggacaggttactgtgtttctatgctcaacaatttgtatcttcataccctattggctgacgcggtattcatattcaagttgaaagcttcggcaacatgcctgacagcgataacgttaatgcccacggctccgctgcccatgtttttttcaccgagcctgtgctgaaaaatcagatattttacatcaacattagccataagaatccatcagataaaaacgagtagtttatctgatgaacactatattgaatacacgctccatatttttctagtcgtcaaaatgaaaatatatccatttactacacttgcccccatcaatataactctgagagggtgcaacgagtaccattcaaagaataaataacatactccacaaagtaaaatcgcaaaaccaaccctgaatcttgtgaataaagttataagtaaaacaggtgaggcaatcaataaaaaataaaaagatataaatatcatcccaacgcttctgtgagaagtaatatcgaacatacttatgtacaaggccgagacaaaactgtaactaccaatcataataattactgagataataaaaataattagttttaacataaatttatttttgattccaaacaccatatttatctaactcctctttcgatatactttcctccagaagcatcgcattgactactattgatgactccgtagtttctactgaagggccttgttgccgacaaaactccactgctcatcgagttcacagatgagcgactggcgaggacgttattcgcttcagcaagagttttttaaagtgcggataacggtattgataccgatttttagcgttcttgccatatcccacacacctgcgccgttaaaggccatatcaacgatctgccctttaactccgggctttctggcctgataagtgtaggtcagttggaatacagagcggcactcacggcagcggaaacggctttggcccttagggttctgaccatgtcgacaaaccaaagcagaatcacaacggggacaatgaacattaatgcaagccatgagcaaacctcaaaaaatcgcattgtacatcaaattcaaccaattggagtcattaccgaaattaatattattcggctatttttaatttatattctttaccaaaatatacattatctgcactactaaacaaggcaccgctgactctaaacgtaatatcaccagatatcacaggaatgccttttataaccagttcatctctacccggtggtcgctctggattatccgatgttaataccaaccctgatccaactggcatcgattctcccttaaaagaagcaatagcaccgcctccccccgttattctaagtttagcataatagggttgtcctaacttaccatcaggtaagttgttgggttcaacttcagcctgcttcataagcagaggattaagcatcatcccacaaccaccaagagaaattgccaataaatttatcgatattattttaaaaaatttattcatcataatttatgacattttttaacatgccgcctccaaaaaattaacactctaaaaaaccatctaacgcttatagattaaaggtgtagatataaatacagttatagtagcaataaaaaacctcacccattaaagataaggacctgagaaagaacacgcccacctaatgtatttttaatgacttctttgtcaaaaagaacatctgcatgtcttttatattacttttcccagtcgggaaagcaccaataattcactgtcgtaattttaatattaaagttacctggtacagcattcaccacggtaatggtcaacaaaaactgaccacggattagctcagtgtgtataaactaaacagtcggtcatcgttggcctcagagtaaggcgattgcccggtaagttcaaagttggttggcgcacaaagccaacatctacctacaggggcgcccaaaaaccgccttaactcaacgtcagcacccaagctacggaggctatattgttcgcagaatgaagcaccatcggcatcagtaggctaccagttctgattctgacctcacacaggatcgcagaaaaaacgaatagcgaaacaaacgtcgccggatagagatattgagtgtgtaccagagcgaacaacagcgaggtgatcactaccgccagcaaccgccctctgcgaccaaaaccaattcccgcattcagtaagaacccacgaaagataatctcctccgaaatcggagcaaacacgcaaatggttatcaccagcaaaatttgagtgaaagttgatggctgtaataggctttccacccagggttccggctggccgaaaaactgaaaaatagcggttaatcccagcaaagcaaggcccggaatcagcatatcctgcaaggttattcttcccaacggcatcagtccaaacgacttctgataatgcttccacgccagtagcgtaaaggggagccagaaaacgatgtacagcagaggagtcgccatacctgagcgatatattcccacatagccaggaaacagcagcagggaaaatgaaagtgcaaaccatcctatccaaacagaaacacaagtcagggcatgagtaacccggtcaatctttccattcatcgtaatattccgttaattatatctgtgcatttggtaatagcgggtttaaatgataaaactgagggaagtcttaactgaagtaggatactaacccaagcgataacacgcattcttcttggtaatacgtgcagcggctgacgctttatgcatcccgctgttttgagtaatttcacccagaagtcatgatgcattggttgtatgcctataaaatagatgataaataattccagccacaaattgcgcgaagaatactcgaatgcatttaatatggcaatatactaaatattagccttagcggacggcgacgaaagcagaaattgacacattattcattacaaaatcaattaattagaacaaaaaatccaaataaccataaaaatcagactaataaactaaattaaatgatttttttgtggaatgattatccatttgaattggagtttaattttattttatttataaaaattataattatcgatataaaatattaaaaaatcccgcgtctacaatttctttacgctgtttattcttaacggtattctttcaaattgagatcatctcagatgtgaatataagtagatccgttttagttccaaacaatttttgagatctcaaccgaataatttcagatcttaagcactctttggcatacatttgttcagccaacagttttcgtcctccagcgctttgagacacttcattatagatgcggccataccgccaagcaggagtaacatttatagcgataactatttatagaaacgatcgtcacgacacacctcatcaacaagcatatctgccccagaatagccataatttggctctcgctagaacgtgatcttttcatccaaatcgcctcgattcatgctacgagagaattatacttataaacacacgttttttcgggggaattacccaatatcaccttatagtcaacacagatggaaaaatttagcgtgccacttcacatagattaaattatgcggcataagttatggtaaagttaatgtagattctgaggttgggtagacgtacttgtttacccgttaacggactcccagaactattagcaatccaattattccctaatgtgacaacttattttgtgatgatacaatacaattcaatttaacatatgcacactggcagtattaaatatcaggaaagataatgttagaaattttcgatgtcagatacgacgagttgaccgatatacggtctgaggacctgtataaattaaggaaaaagacgtttaaggatcgtcttaactgggaggtgaattgcagcaacggcatggagtttgatgaatatgataattcggatacacgctatctccttggtatttaccaaggtcaactaatctgcagtgtgcgttttatagaacttcacctgcctaatatgatcactcataccttcaatgcactcttcgatgacgtggcattacctaagaggggctatatagaatcgagccgtttcttcgttgataaaacccgtgccaagttgctttttggtaaccattaccccataagctacttattctttttatcgattattaattactcccgacataatggctacacaggtatttatactatcgtcagccgagcaatgttgaccatccttaaacgatcaggctggcaggttgaggtgattaaagaagcacatattaccgaaaaagaaaggatatacttactgcatctcccgatagatcgggacaatcaagcacggctgcttttacaggttaatcagcgtttgcaggatccatgttcagtattaagtacatggcctatatcgttgcccgttatgccagaatcggcttaataatttccagttcaacaccaagcccgattgcctgttttgcgttaattacacccaacttttttaccacatttcctatgtgatattttactgttctgggggtgatatttgtgattatggcaatctcttgataggtttttcccatgctggcccagtagagcacttcattttctcgcggggatagaatggctttaccgggcatacctttcccctggcgttcctggatattcatatttctttgactcaatgtaagcatcttttcatgggtttctatcaggagcatttgtagcctgtccctatcattcaacactctactttctactccattcagagcactatcatccataatgagtgacaacattgccaaattattcatcgtatcgtgcagaacaaaagtgaaaccattaacaatgttatatttcttagagagtgtgaagatttttgataatttcagttcagaaaggacagtaatattttcatcccaagagaacggagagaaccgcctgaaagcgatcaggacaacaggatctatattctggtagttattatttgtatagagttcagcccattcatttgggtagctagtgacaatgaaaatatcgcctggattctttttattgatcaccatataggtatattttggactgtcgtagatggtaagttttctgtcgatataatcacgcagtgtttctattacctcgttactcctattgaaaacagaatgcattccctttctccatttactgtactaaggtgcaataggaaattgcaccttagtacaactaccgccccatacccgttcccgtataatggatagagtaagttgatgaaaaaacctagctacttgagtcaggtgacaacaaaagtctagtcaataccagggaaaaaccaaaaataataaaggaaaatgctacagaagtgcacctgtttctgcaagtagaacttctgtagcatttaatataatgtctagctcccctcaatttttgctaaatgtcttgcaaatattttcattgtgattaattgtccctcgccccatgtcaattccttatctaaggtctgtatcattaatcagttttctaaactcagtcagtttgtttttttagcaactgaagataatatcgagcgtgaaccagactctcatcgtaaataaataatttttacccccaaatattgtaattttggtgcggtaatatgagtcatccatttgccacgaatcgcataaattcttacagccttgttaaaatgaaactaaagtagatacaacgtgctgagttaaaggagacaaataatgctaacacgccggaaatttttgatgatgagtgccggagcaggtcttttactctctgtacccatgttggctcgaaccggtgttcagcctgcacaagctgctaccgccattacgcaagtttttggtgacgggatccggctaaccgctgttgcggtcgaatatccgacagaagtcagcgctgaagggctaaaccccgccgactttcatgttgaagggcgaacagtaaccggtgtatggaccagcacttctactaatccggcagatatagcgccctcaggacgctatatgattatagcgctgtcacctgatgacaagaatgcaacgctggccgaacaggtgcagccaaatagtaaaaacaacagcaacaaatctgccaatggaagaggcggccccggtaatgcaggcgatattcctgcctatgatacggtttaccggacagctcaagccacggtactgcgccttccgtcagttcataccgccagtggtgatacgcttcccgctagcgagaaagcattgacaacccaatatgtggaaaacttgatcgttgatgattttcagcagcttgagttttatgatgaaaaaacaggtaaaaagctgaaatacaaccttttcatccccaaagactatagccctgataaaaactatagccctgataaggcttggccgctggtgttattcatgcatgatgctggcgccaccagcgatgttacacgcaccaccctgtatcaaggcttaggcgctattgcttgggcaagcccagaagatcaggcacagcgcccctgctttgttcttgctcctcagtatgaagaaatcattgccgatgatgactcaaaaacatctgacatgctggacaccaccattgatcttatcaatgtactttcagagcagtacaacattgataagagccgtatctatgccacagggcagtcgggtggatgcatgatgacgatagcgatgaacatcaagtatccggatttcttcgcggcctcttttttggttgcgggtcagtgggatcccgcgctggtgaaacctcttgcccagcaaaaactctggattctggtttctcaggatgataacaaagcctggccaggtcagaatgccatcattgatgttctggaaaaagagggtgtccaaatcagccgtgcaatatgggacggaacatggaatgaagagcaatttcgtcaggcttttgaacaaatagaggcagaaaaaagcccgattaactatgtggcatttcgtgaaggcaccgtgattcctgaggggcaatccaccgaaggtgccagcgggcatcgcaatacctggcgaattgcctataccatctcccccatacgcgaatggattttcaggcaacagcgctagttgattaacgagggcttacccaacgccgcacgcttctctttgatcgttcgacagccctcacccttcgacaaaacgacgatttattgagcattaaagccactctcaagctattgcataatcagcgaatctacttttaggcaatagaacattttgtcaaaattgtcccttccctatgataaatttcatgctaataattaagcatgaaatttatcattttttttataaaaaaagacaataaaaatacaataaaaacacaataaaaaatatattttcatttaattacattgcttttgaatggctatttttgaaggcaaccgaagggatgcattagatatttacgacacgtgaatgttaatttaaccatataaaccaagagaggtttatgacatgacaaacaaaataatgccaaaagttaatcgcgaggggcgcagatcattcttacaaaaatcgattgttgtcgttgctaccggtgtagtgacccgtgcattctctgcgccgaacattacattagagaaagatgccaaacctcaacctggaacatgtattttatctgttgaacaaatggctggcccatatattaaaagcaatatgccaataagaaggaacatagcagaaaatgaaaacggtgtgcctttactccttaaaataacagttatcgattcaaattcatgccgcccattagaatattattacgttgatatatggcaatgtaatgctcgggggcgttattcgggatggagttatgttgaccctgataaagacgcaccaagtggagaagttgcgagtatcaacagaactgatgagaaaagttttttaaggggctcacaggtaactgatagtcatgggctcgtcaggtttaccagtatctaccctgggttttatgccgggcgtgctgttcatattcattttgccattaagccaccaaaagtatctcctcaggaggtcgataaatactcatttattagtcagctttacttcccagaagagttcaatagcgaaatagaacaacgggctgaatattcgctgagaaaaatcaaaaggttaataaatagtgatgatgaaatatttaacgaagcaaatggtgaaaatgcagtccttgccgtgagtaaaatcaatgaaaatgacattaatgatggtgttttggcggaaataacgatagcaataaataaagatatcttgtctaaaagaattgaccctaaggatattttaaagatcacatagagccaaacacattcaattttattagtatctaaaatcaataaattagttttttatgaaagctatcccattgaacaccgtccccttttacagtggcgaaaaataactacaaagtattatttacagctcaaggaaataggatggcggatatcacgatgcatttgcacccattgccagcgcagcccataaggtgagtagccaacacttgctcatcatcgggcggcgcgaccatcaccgctaacggaccaacccacgccagtcgtttgccacagatgctggccgggcagcgccagttactctcccacagaatgggcggttgttcgatgctggcaccacagccagccactgattccccccaacaaaatggccatcatgaacgccgcggctaccaactgtgactcaccataaaattttgcgactaccggcaccatcaatgcacttatgccatagcccaatgtatggctggtagcgatcacgccggagcctttgccagtagataaccggtcgttcaacatcagttggtaacccggtgtcgccatcgcggcgccgaaagaagccagcgcacaacctagatagaatagtaccagcggttgaacacacatcagccccaagccaagcaccatgagcaaggctgccactagcagcaactgaggtggcgtaaaacgttgtgggcgaaccaccagaaactgtgccagcaacgtacaacccgcggctatgctaagcaaaatggccacgtggtggctcaccgtggtggccgaatggctaaacaattgacttaggtgaggtgccaggccaagttgcatcaggctgacagttgctgccagcaacaacgcgcacagtaaataaggcaacatattgaggcgtaaacgattttgttgatgcaccactgggggtaacggcgggtcattgtattggcgatacaccaccagcagtgcgatcagtggtgtaattgccatcagccacaggggggctatcgggtgtattgagagcgcgagggcggcacacaatgggccgagcagacggccacagctcagccccgaactgatggtcgccagcgccgccatccgttgctcataaccggcacgctgtagtgcccaggtctggctagcgggcaccataccagagacggtcaggccataaataatacgagccacgattagccagcccagaccggccatttccgataaccaccctgctgacaacccccacaccgccagcgccaataaaacaaagctaagcaagtaacctgccagtgccatgatgacaacaaatttgcagccacggatctccgattgccggccccaccatgccgatcccactaaaaatagcattgagccaagtgtcaatagacccgcccacaccgacaatgacagatgagtgcggcttaccaataccggtaacaccactaataaaccgttttgcccgatgcccagtaacccaacgcagaacgctaaaggccaatgggtagacgatgtaagcccgcttgagcgagcgtcagactctgaggatatgcgcattaaaagtaaattaaccgttaataaaagtgtggttttttggaggagatttattgaaaaatcgtatcatattccaattgataatgataaccgctattgatataagaatcgttctcaatggattaataagcgacatgacatcatgactatcccagtagaaaccttagcaaccgatgtggctgctcaatgtttcctcaacgcgctgattcgtgaaacccaggactggcagatcgttccggcagcgggccaccaaccgtacccacaactccacattcctctttcttcttcacacgctatccacattgccttatgccatatctccccaacacagcatcatcactatctgttccctgcctacctgcatcagcagggtaatgataggcaggatgatgacaccccggtaaaactcgggatcgaacagttggtgacgcttctgttggagaagccaacggtaaaaggtgagctgtctgatgatgtggttgctcgtttccgtcaacgggtgctagaaagtcatgataatactcagcaagcgattaatattcgtctggattggccgtcattacgcgataaaccacttaattttgcccaggcagaacaaggattactggccggccatgcctttcacccggcaccgaaatcccatcaaccttttaatgaaaaacaggcccagcgttatctgcccgattttgcctcccgcttcccactacgctggtttgcagtcgataaacgctacctgtgcggcgatagcctaaagctaacgctacaacaccggctgcaacgctttgccagcgaaagcgccccacaattactcgcgtattttaccgatgacgtttggctgctccccatgcacccctggcaagccgatcacctattgaaacaagactggtgccagcaattagtacaacaaaacgcgttgcatgatctgggcgaagcgggtgaacgctggctacccaccagctcttcacgttcactgtacagcccgtcaaaccgcgacatggtcaagttctcactcagtgtgcgcctgaccaactcagtacgaaccctgtcggtaaaagaggccaaacgcggtatgcgcttggcacgtttggctcaaacgccccgctggcaagagctgcaagcgcgctacccgactttccgtgtgatgcaggaagatggttgggccggtttgcgttcagccgatttcactcttcaagaagagagtctgttggtgctacgtgacaacctgctattcagccaacccgatagccagaccaatgtgttggtcaccttgacacaagccgcgcccgatgggggggacagcctgctggccagtgctgtgcgtcgtttggctgcccgtctgaatctgccattgcaacaggccgctttctgctggctggatgcttactgccagcacgtcttattgccactgttcagcaccgaggctgactacgggctggtgttgttagcgcatcagcaaaatattctggtggagatgcagcaagatctgcctgtcggtatgttgtaccgcgactgccaagggagcggctttacccagagcgcgctgccgtggttggcggaaattggcgaagccgaagcggaaaatagctttagcgaacagcaattattacgttacttcccgtattacctgctggtgaactccagcctcgcggtaacggctgccttggctgccgcaggtttcgacagcgaggaaaatttgatggttcgtgtgcgtgacgcactcagcgccctgcgtacttgcgccaaaaacaccttatgtctggattacgtacttgatagcccacattggcactgcaaaggtaatttcttctgctatctacacgatcacaacgaaaacaccatcgttgatccggcagtgatctacttcgatttcgttaaccctctgcaccagggggtgatccatggggccacacgctaagttaatacactccggtggcagtttttactgtgaacatctgggaaaggcgctgcctcttgctctcgggcttgacggcagtgccgtactgcacttgcctgggccgttaccgccaggttggttggtgcaagcgctggatcaactgttcatcgccgcaccgcagttgaccggtatcgccttgccgtatgccgagtggcgcgatgcaccacaggcgatggctctgtttgccttgacccgcagcgactatgtggcacgggagatattttatcagttaccgctgtggctgggtacagaacgcaaccgggctgcgggtcagatgcaatatgataccgagcggcatctttggtatccgcaacgcccgccccgcccagacggagaagtctatcgccgcttcgatcccaacatcaaacgtaccctgagtttccggttaccggaagtcgatcacgatgccccccagttcacccgttggatgaactcaccgcgcgtggatgccttttgggaaatgagcggcccacttgacgtgcaggcggcttatctgcaacgccagttagattccccctattgctacccgctgctgggatgtttcgatgatcaaccattcggttatttcgaagtgtactgggcggcggaagaccgcattggccgccactaccgttggcaaccttttgaccgcggtttgcacatgctggtcggtgaagagaactggcgcggcgcgcaatatatacacagttggttacgtggactgacgcattatctgtatctggacgaatcgcgcaccacgcgcgtagtggcagaaccgcgtattgataaccagcgtttgttccaccacctacccgccgctggctaccacaccttaaaagagtttgatttcccgcataaacgttcgcgtctgattatgaatcaacgcgccgatttcttccgggagggtacacgatgatcaccaccgattacgctaactggcagcaggttaatcgccacatgatcgctaaaatccttagcgaactggaatatgaacgcactctgcatgctgaattacacggtgaaacagggcgcatcaccttgcccggcgcggtttacacctttaacggcaagcggggtatctggggttggctacatattgatcctgccacgctgcgctgtgagggtgtgccgctcgccgctgaccacatgctgcgccaactggcgctcgtgctgaagatggacgattcgcaggtcgcagagcaccttgaagatttgtacgccacactgcgtggagacatgcaattactctccgctcgccacggtatgagtgcggaagcgttgatcgcccttaatgatgatgccctgcaatgcctgctggccggtcacccgaaatttatcttcaacaaaggccgccgcggctggggcttaaccgccctgcaacactatgcgcccgaatatcagggccaatttcgtctgcattgggtcgcagccaaacgcggcagctttatttggtgcgtggatgccgaatacccgttggacaacttgctcaacagcgccatggaccccgccgaacgccaacgctttgatcgccgctggcgtgagtgccaattgaatgatgattgggtcccggtgcctttacatccgtggcaatggcagcaaaaaattgccttgcacttcctgccacaacttgccgagggtgaactgatcgaactgggtgaatttggcgatcactatctggcgcaacaatcgttacgcacattaaccaatgtcagccgccgtgtgccatttgatatcaaactgccactcaccatttacaacacctcttgttatcgtggcatcccaggcaaatacatcagcgcaggccccgcggcttcgcgctggttgcagcaagtcttcgcacaagaccgcacactgcatgaaagcggggctgagatcctcggtgaacccgccgcaggttatatgctgcaccagacctacgccacacttgccaaggcgccttatcgctgccaggaaatgctcggtgtgatttggcgagagaatccgtcctgctatttgcgagagggtgaacatgccattttgatggcgacgctgatggaaaccaacaatcagggtcatccgctgatcgcggcctatattgcacgttcggggttaagtgctgaagcctggctggagcagatgttccgtgtggtagtggtgccgatgtaccacctgatgtgttgctacggcgtggcgctaattgcccacggccagaacatcactctggtaatgaaagaccatgccccccagcgcatcctattgaaagatttccagggcgatatgcgtctggtcgataaagattttccgcaagcggcctcgctgcctaacgtggttaaagaggtgactgtgcgcttatctgccgactacctcatccacgatctgcaaaccggccattttgtcaccgtattacgctttatttcaccgttgatgcaggcttgcaacctgagcgaataccgcttctatcaactgctggcacaggtgctggagcgctacatggcgcagcatccagatttggcagaccgctttaccttattcaatttatttaaaccacagattatccgtgtggtcctcaacccagtaaaactcacctactcagagcaggacggcggcagccgcatgttgcctgattatttgcaggatctggataaccccctttatttggtcaccaaggagctagcccaatgaatcagcctctggatttcatcggcattggcatcggcccatttaacctcagtattgccgcacttggcagtgaagtttctggctttaacagtaaatttctcgaacgtaaaccgcacttttcctggcaccctggcatgatggtgccagactgccatatgcagacctgcttcctaaaagacttggtcagcgcagtctccccgactaacacgtacagctttcttaactatctggtgcagcataagaaattctaccgttttctgaccaccgagcaccggaccgtttcccgtgaggagtttgcggactacctccgttgggccgccagtggcatgagttcgctcgagtttagccaagatattcagagcgtggattttgacgaccagcagcgccattttgtcgttaccaccccgcgtaatgtctaccacgcgcgccacgtttgcctggggataggcaaacgcatcaaactgccagactgcgtgaccgagcaaaatgaccgctgcttccatgccagcgaaatggcactgcgtaatccagatctgaccggtaaacgcgtcaccattgtgggcggcggccagagcggggcggacctgttcctgaacatctttctcgctgcatgggggcagccaaagcagctgaactggatttcacgccgtaacaactacaacgcgctggatgaagccgcttttgccaatgagtacttcatgccggaatacgttgagagtttctacaccctgaacgacagcgccaaacagcatatgctggcagaacagagaatgacctctgacggcattaccagtgaatcactactggcgatttaccgtgctatgtaccaccaatttgaagtgttacgtgaaaaaccgtgggcgcgcctgctccccagccgctcactgaccaatatgcatacgcgcggcaacggttaccaattactcacccatcaccatctcgatcaaggcacagagacttttgataccgatgtggtaatcttcgccacgggttatcagcaggatcgtccggcgtttctcgatccattagctgatcgtctgcaaaccaccgccgattgccagtaccaagtggctccagattttgtcctcgactggcaaggcccgcgtgaaaactgcttgttcgccgtgaatgccggtatgcatagccacggcattgccgaacctcagctcagcctgatggcttggcgatcagcacatattctcaaccgggctttagggcgcactcagttcgatttaacttccaccccggcggtgatccaatggcgcagccaacagtcgggtgtccctgcccacccggaacatcccgtgctcaactgcatcgacatttaaatacggcaccaagcgtcaaaatataacaggcgaattttaacgccatagaccaatattgggagaaagtcacaatgaaacacaaacacctctgggtattaaatccgtgtctgctggtcatgctcacaccagcggcgtgggcagaggatcaacttgtggtttcagccaaccgctcacaccgcagcgtggcagaaatggcgcaaacaacttgggtgattgaaggccaggaacttgaacaacaagttcaaggcggcctggaaatcaaagacatcttggctcaattgatcccaggtatcgacgtcagcagccaaggccgtaccaactacggcatgaacatgcgtggccgctcaatcatggtgatgatcgacggcgtgcggctgaactcttcacgtagcgacagccgccaactcgattcgatcgatccgtttaatattgcacacattgaagtcatctccggtgcgacgtcactttatggcgggggtagcacggggggcttgatcaatatcgtgaccaaaaaaggccaggaaggaaaacaggttgagttgcaaactggcggcaaaaccggctttaacagccataacgaccacgatgagaacatctcggccgccatgagtggggggactgagcgcgcattcggccgattctctgtttcttatcaacgttatggggggtggtacgacggcaaaggcaatgaggttttgatcgacaacacccagaccggcttgcaatattctaaccgtctggacgtgatgggtacgggaaccctcaatatcgacgaaaaccagcaattgcagctaaccactcagtatttcaacagcgaatccgatggcaaacacggcttgtatctggggcaaaacttctcagcagtaacgggtaccgggcaggcctccaacagcgcagcgctaaattcagaccgtattccgggtaccgaacgccatctcatcaacttgcaatactccaacacggatttctgggggcaggatttagtggcgcaagtgtattaccgtgatgaatcactaaccttctacccattcccaacactgaaagatggcaaggtgagcactatcggtgcatcacagcaaaaaaccgatttctacggcagtaaactgacattgaacagtgaacctatcgatagcctaacactgacttacggtatcgatttggaacatgaaagtttcaatgccaatcaacagttctttaatctggcgaaggcacagcaatccggcggcatgacgttagaaaatgcctacaacgttggccgttacccaagttataccaccaccaacctggctcccttcttacaaacccgctatgacatcaacccgattttcactctgagcggcggcgtgcgttaccagtacacagagaacaaggttgatgattttgtgggttacgcacaacaacaagcgattgccagcggctccgcgacttccgctgatcccgtacctggtgggaaaacggattacaacaacttcctgttcaatgccggtttactggcgcacctgacagaaagccagcagacctggttcaacttttcacaaggatttgagatcccggatctggcgaaatattacggttctggctcctacacgctggttaacggtcactatcagttgcaaaacagtgtcaacgtgaatgactccaaactggagggcatcaaggttgattcctatgagctgggctggcgctataccggtgataacctgcgcacccaaatggcgggttattactcgctttctgatcagactatctcgatcaacaaaacagacatgaccatcaatgtgttaccggataagcgccgaatctatggggtagaaggcgcagtagattacttcttcgataacagcgaatggagtgccggtgcaacatttaacctaattaagtcggaaactaaggttagcggtaagtggcagaaactgactatcgatgctgccagcccgtcgaaagccaccgcctacattggctgggcaccgggtgattggaatctgcgcgtgcaatcccaacaaacgttcgatgtttccgacagcaagggggacaaaatagacggttacaacaccatcgattttctcagtagctacgccctacccgtgggaaaactcagtttcagtatcgaaaacttgctggacaaagagtacaccaccgtttggggtcagcgcgcaccgattctgtatagcccaacctacggctcacccaacttatacagctataagggccgtggccggacttttggtgtgaactactcagtgttgttctgatagatagtgttgttctgatagagacgggcgttatctcgtcttccgcccgttcatcacccatcaataattaaggggctttgcgcaaaattaagacattgcgcaagcccctataatttgtttatggcaattcgcttacgacaatatccgtttacgacaatatccgtttacgacaatatccgtttacgacaatatccgtttacgacaatcctatcgtttattactacaaacgcgttaattaagaccctctcacaccatagcggtttattctggcggctttaatccattcacgccctactgagaatcactttatttgcctactgaagagtggaatctcccttgtttcagttcttcacgaagaattgcatgttcatcttcggtaaatttatatttacgcataatgaggatacgcaccacggcacccacggcgggcaacagagaaatacagaaaaataggccattcaatgtccatgtcgattgggccacattaggcatatatcccaatattgacaggatcaggccagagacaccgccagcaacagcgaccgacaatttaccgacaaaagtctgtccggagaacgtgatggccgcgcagcgcttaccggtgtgatagtaggaatattccacagtatcggcaatcatcgcggaaataagtggattcgtcatcatgaagatggcagtgatcacggttagccataccatgactgacacgacattattataaccggtgaaccagaaaccaacgcgagcgatgatctccaacacacataatgtaatgaacaaatctcgcttcttaaaatggcgggttaagaatggcgttcccagacaagctaaagcacaggtgaatgtaattaagccgataacagaaaccagctcagcatcccccatgttataagtgaaaaagaaaatataaaaagtattcacgatgttagaaaacacattcatgaaaaaggcgctaagaataaaaaatagcggcttattttgccagaccacaataaatgtctgctttagcgtgaccttttccgtcaccgtgacgttgacgcgttcttttgtattaaagaacccattcaacatgagtatcacccccaaaaccatgaggataacaacacccgcaaaataaccacgatcagcactgttctcagcaaataacccgctgatataagggaataaaatcatcgtagcgccgatacccgcattcacacccaacatcgcgcaggtcgctgttttagctcgctcttgcggttcatccgtcatcacggtgctcattgaccaaaacgggatatcagagagagcgtagagcgtcccccacaggatataagtcacacctgcgtagatcgttttagtcatcaagctggcttcgatattataaaacgcagcgaccgtaacaaggaaaatcaagaagggagtaaacagcaaatatgggcggaatttcccgcgccgcatattaatagtatccattacaccggcaattaatgggtcatgtatagcatcccataccctggcaattaaaaagatcatactggctgctaccggcgagatccccataatgtcagtatagaaaaagagaataaaagtcccaaccaacccaaaactgaaacactgccccatcccatacccaaaataagacgccagctctttcattgggattttcatgcctgaattgttcatatttatttttagccttttatccccttcgtccttcaagctacagaggtgctggctgtccaggctcatcccagtcacttagttctttaagctcctgggaatttactcggttgccgcctacctgcatctcgaagtcacttgggtatatattatgtaaggtacagataaatttttaatgcccgccacagcccgatatgtcactgaggttgctatggcagagcaggctatatttatgtatttttcagagctaacgcctttagcagttccatttcagaggggtcataagcggtaccctcctcattaaaaacatcatggaaccagcgggacgcatagtcattatcggtacgtttaatttcaggccatggaatatgagtttgagtcgcgcctttgactaacccccattggtagcaaccaataccttcagcgttaaacaaaggtaactgttcatgcattttcgattcggcatgacgggccaaccattcggtacacagcattgggcgcttatattctttcaaaaggccaatcgctttgttcattaaatctaatggtacataggcatggaaggagatgatatccgataattccaaggcacgtatatccgtcggatgctgataaataggtgcaccgagatccagaatattagcaatatgccacgcgcccaccgtgagtggctgtgtcgggttgacctcccgtgcccacataaacgctttttccattaactggtggctatattcttccagcgccggatcaaaagcgtcttcacccgctaaggtgaaaatcatacggttggttggctcgttgtagagatcccatatcacgatccgttcatcgtgagcgaaatgaccaataatctctttgagataccgttcaacctgtccccataaataaggctgcatgaccacattgcgaccagggctggcggcagcctgactattatgcaaaccgggaataggttgtttttgttgcccgataaaaggatggtcaccagaaaagccacaatcatccattagcgttaacatcactttgatgccaacacgttggcaaatatcgagaaaatgctcaactctagtcattaatccatcaggatcatgctgccagacaacaaagggcaaattggtccgcagtgtgttgtaccctgcctcagcagcccattgcagctcttgagtcatacaagccggatcgaacgtatcctgttgccacatttcagtccagttgacggcggtacgcggtaaatagttaaaaccacgcaaccacccctgctgtttatgccattcccatgacttttcttcagaccatttgctcataattattctcatctaataagtagccacatcctagctaatatattagctaataaactaatatcaaacagtcatcgcatcaaaagtgactctcatcacaaaattatttttagcaagcaaggtaaatcaataaatatcaataatttatattatttttattttgtaaagcataaatgaggtctccgaagacagatcgactgagtgggatatcagcccggcagaccctgatgaacagtcctgctagctaaaatctgttagtataaaaaaagatgaaatatagccagtatgagtaaaatatgaataaaaaaacgaaagtgactatgagccacattgcggccaaagcgggagtatcacaatcaacagtttcattggtgttaaacggctcttacagcatcaaactggcagatgacaccagagaaaaagtcctgcgtattgctcaggagatgggctatgttcataaagccgtggaacggcccattgccagagataaaatagcattaattatcaatgggctaataaaccacgatcctttcattgaagcgatcagtgctgttcaacaggcagcctggcaacacaacaagctattggcgatttttgatcaggaaaatgaaccagagcactgcgcagcacttgaagaggaaatctgtcgaggaggttatcagggggtaatttacgcctcttgcatgaccagccagctagcgccgatgtttcgtaatctgtccatcccaatggtaatgctgaatggttattgccctgagctacctgatgttccctgtattttacccgcagataaaattggcgcttataaggctaccagccatttattgcaacagggatataaacggattgccattctggctggcgaactgtggatggatgccgccaacgaccgtattagtggctaccggcaggcactcatcaaccatgatatttgccctgatgaaggttatatccaggtgacaaactggtcattgaaggaagcgtataaaaaaacactggaattgctggcactcactgccagaccagaagccattttctgcagtagtgactatatagcactcgggtgttatcaggcgattttgtcacaagggttgcgcattcccgatgatatcgccgtcgtgggctatgataatcaaagtatttcttccgaactgtcgccagaattaagctcagtagacttaccttacggtgaaatgggtgaaatagcgctgcataccttactcaacatcacgcagcagcaacccttgctgtcattgaaaatgaaggtagaaggcgagttggttatccgacagtcttcaataagaccagagaaatagcctaccccgcgccagcctccatttaattgggcacggctcctaattgagaataacgcctcctctcaattgagaacaatgcccacgttcaattaagaacagcatcccctcaattgagaacaacgcttaattgagaaaaattcttaattgggtgcaactctcaaaattaacattttttactaagccataacgaattgctcatttattatactaaaaaacaaacgcaacgatataaccccatgaggttcacgtgatctaacgataaaaaatgaggatactttgttatggctgacgcacctttatcgactgctgcaccgccctcaatctccaggcgtaatttagcgattctgattactgatattctactatttattcttctacttaacgttctacctttcgacgctaacgccaatcgcggcctggccatcttggcctttattggcatcctctggctgaccgaagcccttcacgtcacgatcaccgcgctgttggttcccctgatcgccgtgggtacggggctaatggacgttaacacggggttgagatccttcgctaaccccatcatatttctattctttggtggctttgctctggcaacggcactgcatattcaaggtctggataaactgattgccaaccgcctgctacttgcggcgaaggggcaattgatggttgcggtgctgatgctgtttggtgccacggcattagtgtccatgtggattagtaataccgcgacgacggcgatgatgctgccgctggcattaggtgtcatcggtaacctgaacctggaacgagaacgtaatacctatgtctttattctgctgggtattgcctatagcgccagtatcggtgggttgggtaccttggtggggagcccgcctaatgccattgcagcggcacagttggggttagattttgtcggttggatgaaatatggcactcccgccatgatcattctgatgccactgatggtggcgacgctgtacgtcattctgcggcctaatcttaagcatcattttgatatcgaactggagcaacaaccctggacgaccgcacgtagaatcacgataggtatattcggtatgacggtcattggctggattttcagcagtcaattgagccaaatgctcggtggggtgaaacagtttgatacgctggtcgcactgagtgcagtcgtcctgattggcattagcggcgtcgccagttggcgtcagattcagcaaaataccggatggggggtattgctgctatttggtgggggcttgacgttaagtgttattctgcgcgattccggtgccagcgccgtcatggcacaaggcattgtctccatttttggtgcctatcactggtttattattattctggcagtagcgacttttatcatcttcctaaccgaacttaccagtaatacagccagtgcggctttgctcgtgccggtgtttgccactgtctctgaggcgttaggtatgccaccgcttctgctcaccatgatcattggtatcggtgcgtcctgcgcatttatgctgccggtcgccacgccaccaaatgccattgtttatggtacgggttttatcaggcaacccgagatggtgaaggttggtttttggttaaatatcatctgcatcatcgttgtctcgctgttagcctggtatctctggtattaagcgctgaacctggcggtacattacgccgtcagggaattaggcccctgcatgggcctaatttatggggcaatgacaaagggcgcgcttatcggtgatcaggtctggcaaaaagggggattacccaccaccgatttaatattccctatcgggtaatttgttaaatcgcagccataaatcggtcagattttgaggtcagcagcggtcagcagcgtttctgaacccatcaaaatgatgcgcttcacggcatcatcactcagtgtctgtggggccgcatataaagaatggtatcccttggggaagctcggaacggtaaactcccgcataatccgctgctctacctggctgacccctccttccagcatctcctgtgcatgaatcagaatatgagtacgtaaacagcgccgctttaattggttaataaatccaggtaagacttgtgataccagaggatataggcaggcctcagcaataaagaactcgccaatcaacagccgctcagtactgaaattagccgtgccggagacaactttctggctatccagatttttcaaagtaagatgatttttgcgtatttgcaggtagaaaaacggcatgttcccttgtcactcatggtactgatatcctaatatttggggcatgtgctcaatatttttgaatatccattatttggaacctaagtattgcgtaattgtttgcgaagtgcaatctataaggctctgttgagaatagtctcaaacagaatgtctgataagcgggggagttatattttcaggcacgctaagtcagtaaataacgaatatcacatcaacctaaaaataataaaatccattcagtcttccataaaaaattagcgaaaactgttaagcttactaagctaataatcatcagatgatgactctcaatataaaccatcacttagcttataaccccccattggccaggcttcaatcgttaatacagcatcatcctccgtgagggtataaactgcgatagcgatttttctgcctcaaccaattaaaaaatcacacttttaataaatcagttttcacactgtgaaatataaaaaatcaacgaaaactgacattaactaactggaaaatttaatttaaatagttccaattggtttgcaaaatcaatcacaattcactttttacgcttgctaaaataccatataatttatttctatcttcaagtgaaatacctaaatcctccatcttatcaatagaatgctgtaaggcatccaaaaataaattggctcgttgagagaaattaccatttaaaaattcattgtggtctatcttcaatctaaactctaacactttccgtttaatattccgtttagcaacttcatctgcccagtttttactatcacgaatcatgacaataaaagcccatttgtcataatcatgatcgaacgtaatttcatcaagattgctattaacttgcttctctatgaaaatcctggtctctctatataactcagcaacatctatatcagcctctgacgatacccataatttcataatttaataatccgacttgtttagtggaggacgtcttccgccattattggctttatattctaatatcttatcgtgttgccacttatgcatttctcttttggaaccatcagccataaagatgacatctgcattattttcatcaagatatttttgtgaatacctactatctccttgataacgcttattggcaagagggccaccttcccggctaataccaccataacccctaactttcaactcctctaaaatattaagtgggttgttaaatatacatctatttattgttactaagtttttttatatatcttcttgcatagctccttattggagtgcttttggtacattctgatagtttttttattttttcaaattgagagagatctttcagttttgttaatgcttcaattgaatgaatagcaacctctggatcatctatcagcttagctaaaataggtaaatattttgtactaccatacttatctaataacatcacaaaagactgacgccctttaccatgttttttttcagtacacattgaagagataccatcgagaagggcattttctccacaatatttttttaaaataggttctagtaacacataacttgagtcccaaatcacacgttcatatccataccaatcaggtgctccatcaaccccttttattgatatacccgttctggtagcaaccaagtcgccacagtattgtttaaaagcattaaaaataacacttaaactctcaacattatctaaagctaaaatttcttcatctaatttctgcctataaatattcatcatttatttaaatcagtcataattatatttaaagggcttcccgcatgtaaatcacccccttaataaaaattcagttatttagcgcgccaagtcatagaataagcagacaagttatcatctaaataacactttaaatataaatacaagttctttatcgtgcctctccatttacatcatatacccgtagttccgtagttccgtagttccgtagttccgcaaaaatttcatcaaccttcataccaaacatcttcataatcgttttcatcagaaataaatttaaatcctggagccaatgcaagatattttaaaataaaacttggaacaatatcgtctatatgtgaaaaatgaattggttggaagaagctctcgtcatccgaatagtcaccgccccatagataccatccacaagagccattctctctagtgtgtcgcactccatatataggctgtttcataagcgaatttattgcaacacctataacttcatcacctgaacaaaagaaacaaggtgaattatattttttacaaagtttttcttgttgtttccgcattttttcatccatcattaattttattttttataaatagctaatacttaaccactttgagtagctctaatatttagagctactcactaaaaaaataagaaattatgaaaatcaacaagacatcaataaatacatagataccgaaatctataacccgatgctttttagttcaatctcagaaaaagaaattttatctcgggcaaagggcggttttttctgcccaggaattaataggttatccatgaaacttttatcataaaaactatcccatggataaataccaaaatacatttccaatacccaatgagtgtccttttcctctttgtcataccacccccacgttcctgtaatgtgttcttctacattaacatttttgtactcaacttttctattccctattaacttccattttttcttaaatggatcatctgcaatagtaaaaacaaaaactggtttggaaagagacaattcattttgtctctctatcagttcttcaaatgtagagaatctatgattaaaaaaaccacatgttattgaataataaccttcttcgataccttctacgagatagcatatatgccctaacgtccaagaaccatcaaccaaaggaattgcatataaattatataatattggattgttttttttctttttcttaatcattttttcatgcatcccccattgttagcatagcgatcatcattcatttcatgacgttcattttccaatcctgctccattaactccagttggcccctcacctgcacgaatccaatcttcttcagcttttgctagcggatcggcccctactatagattgctctaattcgacaaaattatatccttgatgtgtcggatcatttttctttgcttttctatcatgtgcctttttacgtttttcataagtttgttgattctttgatttacctatatattctcgaccagatctacgatccgttcttaaataaataatacctgtcaaccccagcggatccacccatcccagcgtattcaccgcaaactggtaaggatttaatccgccttttaaccctattgggtcctggctgataaagacaccgcaggccggatcataataacggtagcggttataatgtaaaccgctttccgtgtcgtaatattggccctgcatgcgcagcggctggcgcagttggctggtacccgtgacactcagttgcccgaacggggtgaactgtgcttcccataccacttcgccttcgccatcctgcaggcggatcggcataccgttcgggtcattctggtagaaataaatctgctcttcgcctaatggcgcgatttcgccgtcttcagcttccgcaatctgttgataacgctgcagggcgcggggttcgaagctatctggctgatacacgtaaaactggccgctgtagacgataccatccggtttgtcccaggtttcaggcgtcaccacccggggggcaacttcacgctgcaactcgcccaccatcacgtcaccgtcccacataaaccaggtttcatcctgccacaccggttcaccgcgcgagggggtctctttgtcgatcacccgcagcccatcaagcagtttggtcggccgttgaaggtgccgtttgcccacccggcgccccagcgcatcgtaggtataagcgtgatcatggtgctcatttttgatgccggccagccgaccaaaagtattccagcgcagggctaactggctaaaccggtcggtgcgcgataccaactgccccgccttgtcgagctggtaggcggtgccattatcgtgctgcgtgtgccggccctccgcattgtcagccaccgtgctgaaccggtcaccgcaggcatcataacggtagcgatgcagcgtccccagcggatcctgatagcccacaatctgccccagcacatcgtagtgataacgctcactgccctgccggctgtcctcccgctgcgtcagattgccgtgctgatcatagaagtagtcggtttcactccagaccatgcccttgcgccgtgtctggtaacccgccagttgcccggcagcgctgtaactgagatggtgcgacagactcggcgttagccgttgttcggttaaccggccaatcttgtcgtagctgaacgccatcggcctgtggtcatcgatctgctggctgatgcactgccccagcacatcgtagccgtagcggatccgttgctgtacctgaatgtcgtcctcatcggtatattgcaacagatggcgctactcagcctgctgaccggcggcattatagccatattccaccgtcgcactgacctgcggttgctgctgaatttcctgcgctaactggccgtcctgattatagcgccgcgtcaccgtcaccgccgggttcaccgccccgataagctggccctgaacgttatactcgtagcgctcccacgcctgctcatcacccgcaatgctcttctcggtgatgcgccctaatttgtcgcaggtgaccgccaatatctgccctagcggatcgtgactgccggttaaatgcccaaccgcattgtactgataaccgcggctctgcccccagtaatccacttcttcgattaaccgcccttcggcgttacgcttgagctgccacgttttaccgcgctgatttttcaccccaatcaactgttcttcggtgtcgtacaggtactcggtctggctgccatccggatcggtacggctttgcaaccggccctgaccaaaatagccaaagcgggtgatacgtgagccgttctcgttgtagagcagtagattatcttcccgatcatattcacagcggatggttctggcatcgggcagcgtacagcctgttagccgctgttttttatcgtactgatagcgagtgatatcgccattggccgccacttttttcagcaaattaccgcaaaaatcatgcttaaatgacgtcgcgttaccccgcgcatcggtaatgacccgcaaaaagccccaggcatcataggccagttccgtgcgctgctggctggcatccaccaccgccaccagttgcccaaggtcatcataggtaaaatgggtggcgatcttgcccggcgtggtctgcgaaatcaccttgccctgtgcatcccagctctgccgccagaagcgcccgccgggatcggtaatgcgcaccggtttatgatcatcgccatactcggttttcacgctgctgcggtcggcaaaggtctcttctgtcaggttggcatattggtcgtacacccagccgtgggtattgcccgccgggtcaatctcggcgatggtccggcactgtgcatcatattgataactgtaaaccccgcctaatggcgtgacgcgggcaaacggcagcccccgttcgtcgtagcgcagcaaagtggtgtggcccaatgaatcggtgatttgggtttcctgatagacccgatcataatgaaaacggtaatcgaacagcccgccatcaccccaggcgtgctcgacccggttcagcccgtcgctgtggcgctgatagccgtagtaaaacgacaatccgttgcggtcggtatggcgcaccatttggctgtcagcgatatattcaaactggtagggatggttgtccgcatccagcgtggcaatcaggttaccttcgccatcgtggcggtagcccaccagaaaacgccgctcgccattggttttattcacgagaacaaaatcgttgagcatcccgctgatgggggtgttttcatcctgaatgacatgcacttcacgccccgaaagcaacccttgtgtcagttcgatcaacgccagcaacagcgaattgccctgccgtttgaattgccagccattaccatagcgatctgccattctcagaatgggcagcgtcagacgatccgccgccgtaaacgggatcaccgtgctttcccagtcattgggcaacgtgaagaaatactcttcctcgtggcgggtgcgcaggaccaactggttacccgttagctagaaataaattcccaatgctaaccattgggaatttattttacttaatgtcattaacattcattgaaaaaattactttatctaacttatcgacaacctctatttgactttgttctgtgacctttaaatccttcagatgataattgaaaacaaactcatttggaaaatcagtcacgatatttttttcaaaaacaagactatctttattaaaaataaataaatctaaaaaaaatttttctatagtcaatcggcatttcaaatgacattctatttttgtacctttaattttctttttttttaaaatccattcatttttatacccagcttttttaaactcctcaatgccctcaacaatcttttcacaaggtaaactaaactcatcagtacacttactcagcccagttaagagaaggctaataaaatattcattcaactgattttttggagtgtttaagtatattttttcatcgagaaaaaactcaacctcaagaacattacaagagttaacatagtcatgttttttggggtttttcctgccaacaaaacaaactcttttaaaattagtcgtttggtatttttccgattttatatatttttcaagataattacacaatgaacgagtctgttctttaaatggaaaatttatatcttttccataatcagataattcagggtacaaataaatctctttaaatatcatggtctagaatgcctcttgggatctaatgttttctatgatttgttgcgttacctttttcccaatctaagattttactcctagcgccttcaccctcttgtgttttcttcacaactgccgatgaatacctaccttcatttccgggttcgttgttccaatctcttacctgtttttcagctctggctgatttatcatctgctcttatacgaccactacttacccccgttttagcgactgtgttaccagtatgggaatcatagatttcataaccatgttacggggttttctgtttaactctcgttgcatccagcctctaaaataatgtggttattttcccatcattttaggtaatcaaacccacaccttgatatttattaggtatatattttcattaataaatccaactaactattatttcctctacttttttaaggttcacccttgataatgaacaaataacaaccatctcattttttccattagtatcaatccatgactcaacaccgtcaaaatcatcaggcaactcttgtattatttttatcgatttattgctagactttgatttcgcagaaaaaataggattcgcatccataaacttttttccattagaaaacaccgttttataatagggaataatccaattacatctatcagattgtttaattaattttaaaaagaaatcaacccaaaaattttcaagttcaagataaacttcttcgttttctaagtaatttttaaacatgctattttttccttttatttttacaggaagatatcgaagcggcactatcctcattattatttggatctggaacaaacgattttcctgagtttacttctatatcaacctgctcaatacaaaaagatctatctgatgaaagaagaataaataaatcattaatattcaaaaattgttttttctcctgactatttttacagttagcctcaataacctaacctaggtgagaatacatctcaacaaccagatgaggcttaattaacgacatgaaaatatcactctcctgttaaaaatttgctaggccgaatcactttaaggctttgttgtaatcaaaatatttaattatgtgccattcttccttttaggtactttagcggaatgacacagaattaataacactcctcaattattgaggataatattatatttttatttttatgcctttcaggcttatccccgactttaataagtctaaaataccaatttttgaacattccacaatataatgacttaaattattaaaatcagtaaatttaacatttaacattttcattttatttttatctattggcggtctatgtgcatatttttctttattaaccccccatacaacatcttcatttgttgggattggtatatatatagtatagcttttcattaattcagatgaataaattgatccttttttataaacgccaatttcacgtccttccttgcctaacaaggataaaaatcggatattccattcaggaagaattttttccaagtttaagtcctttaataaatcgccaaggtagctctcaatagctaatctttcactatgcaaattaggaaagtcaaatatttctggtgttaactgaactttaaatttcataatcctatcccttcttttttttatttttacaagatgcattgctatcagagtcagctctataagctttatccctttctttgtttaatggtagctcatcacctttagttcttaaatctttgacagccttagcttctacctttttagcatcacccgttgacgtataccctaaatctctataaggagttgctactgcatcggaataaccagcttttttggctgcacgttcactattatgcattctcctatttgttccatccgccatcttgtcttcagatttagctttacctatctttaatatcttggctcctggctggtcattctcatggacaatataaagttcattatatcccattgaattattagagtttctatgcaaccccagcggatccacccatcccagtgtattcactgcaaactggtacggatttaatccgccttttaaccctattgggtcctggctgataaacacaccgcaggccggatcataataacggtagcggttataatgtaaaccgctttccgtgtcgtaatattggccctgcatgcgcagcggctggcgcagttggctggtacccgtgacactcagttgcccgaacggggtgaactgtgcttcccataccacttcgccttcgccatcctgcaggcggatcggcataccgttcgggtcattctggtagaaataaatctgctcttcgcctaatggcgcgatttcgccgtcttcagcttccgcaacctgttggtaacgctgcagggcgcggggttcgaagctgtctggctgatacacgtaaaactgagcgctgtagacgataccatccggtttgtcccaggtttcaggcgtcaccacccggggagcaacttcacgctgcaactcgcccaccatcacgtcaccgtcccacataaaccaggtttcatcctgccacaccggttcaccgcgcgagggggtctctttgtcgatcacccgcagcccatcaagcagtttggtcggccgttgaaggtgccgtttgcccaccctgcgccccagcgcatcgtaggtataagcgtgttcatggtgctcatttttgatgccggccagccgaccaaaagtattccagcgcagggctaactggctaaaccggtcggtgcgcgataccaactgccccgccttgtcgagctggtaggcggtgccattatcgtgctgcgtgtgccggccctccgcattgtcagccaccgtgctgaaccggtcaccgcaggcatcataacggtagcgatgcagcgtccccagcggatcctgatagcccacaatctgccccagcacatcgtagtgataacgctcactgccctgccggctgtcctcccgctgcgtcagattgccgtgctgatcatagaagtagtcggtttcactccagaccatgcccttgcgccgtgtctggtaacccgccagttgcccggcagcgctgtaactgagatggtgcgacaggctcggcgttagccgttgttcggttaaccggccaatcttgtcgtagctgaacgccatcggcctgtggtcatcgatctgctggctgatgcactgccccagcacatcgtagccgtagcggatccgttgctgtacctgaatgtcgtcctcatcggcatgttgcaacagatggcgctgttcagcctgctgaccggcggcattatagccatattccaccgtcgcactgacctgcggttgctgctgaatttcctgcgctaactggccgtcctgattatagcgccgcgtcaccgtcaccgccgggttcaccgccccgataagctggccctgaacgttatactcgtagcgctcccacgcctgctcatcacccgcaatgctcttctcggtgatgcgccctaatttgtcgcaggtgaccgccaatatctgccctagcggatcgtgactgccggttaaatgcccaaccgcattgtactgataaccgcggctctgcccccagtaatccacttcttcgattaaccgcccttcggcgttgcgcttgagctgccacgttttaccgcgctgatttttcaccccaatcaactgttcttcggtgtcgtacaggtactcggtctggctgccatccggatcggtacggctttgcaaccggccctgaccaaaatagccaaagcgggtgatacgtgagccgttctcgttgtagagcagtagattatcttcccgatcatattcacagcggatggttctggcatcgggcagcgtacagcctgttagccgctgttttttatcgtactgatagcgggtgatatcgccattggccgccacttttttcagcagattaccgcaaaaatcatgcttaaatgacgtcgcgttaccccgcgcatcggtaatgacccgcaaaaagccccatgcatcataggccagttccgtgcgctgctggctggcatccaccaccgccaccagttgcccaaggtcatcataggtaaaatgggtggcgatcttgcccggcgtggtctgcgaaatcaccttgccttgcgcatcccagctctgccgccagaagcgcccgccgggatcggtaatgcgcaccggtttatgatcatcgccatactcggttttcacgctgctgcggtcggcaaaggtctcttctgtcaggttggcatattggtcgtacacccagccgtgggtattgcccgctgggtcaatctcggcgatggtccggcactgtgcatcatattgataactgtaaaccccgcctaatggcgtgacgcgggcaaacggcagcccccgttcgtcgtagcgcagcaaggtggtgtggcccaatgaatcggtgatttgggtttcctgatagacccgatcataatgaaaacggtaatcgaacagcccgccatcaccccaggcgtgctcgacccggtccagcccgtcgctgtggcgctgatagcggtagtaaaacgacagcccgttgcggtcggtatggcgcaccatttggctgtcagcgatatattcaaactggtagggatggttgtccgcatccagcgtggcaatcaggttaccttcgccatcgtggcggtagcccaccagaaaacgccgctcgccattggttttattcacgagaacaaaatcgttgagcatcccactgatgggggtgttttcatcctgaatgacatgcacttcacgccccgaaagcaacccttgtgtcagttcgatcaacgccagcaacagcgaattgccctgccgtttgaattgccagccattgccatagcgatctgccattctcagaatgggcagcgtcagacgatccgccgccgtaaacgggatcaccgtgctttcccagtcattgggcaacgtgaagaaatactcttcctcgtggcgggtgcgcaggaccaactgattacctgaacgatacagggcgtgcccctgctgccagtcatacacccgctcatcccagccctgctctatcggcatcagcgagaagacggtttcatgatccgggaagcgggccaccacgccgagttcgccctgatcgaccaacacctccagccgaatatctgccgggcactgccagcgctggccaatgacaccggtcaccgctttctggctgccataatagcgatcccacaccagcgggaagcgcccttccaccacaaaatcgttctgctcaaccaccacttcgccagtgatcgaattgaccggctccgcatccaaaatggtgcacttcaggaagccggattttaatcccagtttttcggccagcttcttcgccaacttggatccacgaaatatcttgaacagccccatcattaaggcgaacaggttaaggactggcatgccgcccaccaccaccgggcggcccatcgggatcggcaacatgacggaggtgggtaacgacaggctcttgcgttgggtatgggccgcgtttttcggcgtcgagggcaggccgacaaaccagcaactcatggcgggtagggccatataagacagcggatcaccgttggccataacggttttgctgcccataaaagattcggaatctttgctggggatcaacggcgcgaacagggtaccgaggggaaaatgcagccccggaatatgaaacgtgtgcgtcccgacggtactgcgcaatgtgccattcacttttaccggtcggttagaccccccgccgccgccaatattgccacccagcgtgtcgataatgcccgctttcaacccggatagctgatctttggcatcttttaacgccagaccggtttttactaccggattattcgccgcggcctccagtgcactccctgccttgctgaccagcgccatacccgccgccaataattcagggttgtcctccatcacatcagcagcggcctcagcgacaaaactgaacacaattgaaccgaccaccgatttaacgccgttaacgcactcgcgtaaatccagcacaaatcccacatggggatggggaatagggatagggaccggtgagggaggaataatgaccgtatggacatccagcccaatgaccggatcaaaatgttttaccgctggcattgccattatcgctccctgattagcctgcggctaacgttatatttctttgatcaagcggcgtgataatatccagccattcatcaccgtatagcgcagaaagaacagtgcgcagctcatcgtcataattctcccagcgcccataatgttgatgcatccaataagccgcgacgccaaggctactgttagtttttatatcgtcgtccagcggtaagccgattttcaatgcattcaatccggcattccaggccagcgtaaaataattatcttcccaccagcaataagcactcatacgccaggtttcaatcgttaataccgcatcagccgccgcctcggtataaggcgcaatactttcatagcattgtgctgccatggcatattctttttggctgaaataaacactggcttcaccaaataatgcattcgcaaccaacttattgcccgcaggatggtccgctattatggcattctcgccttcttgcgccgctgattgataagcgcttaatgctcgtgggaaatcctgccattttaattgtgcggctcccactaataaataaatcactacgctttgatcgaaccagccctctttttgtgaaatattcaacgcctgcttttgtaagcgcgccagacgcgaagggtcattcaatgggattgtttctgttagggcaataaataaacgacgaaaatcagcacccggcccccgctccgtggattcctcaaccatttcacccggcgcaccggccatatgatatacgccgttaatcaactgaatattttcaggcgcagcctgtgataaggattgaataccgtctgaaagctcaccgtaaagaaccaaacgcaggcgctcggcaagccaggggtcaagacagagatccgcggttaatgttaaaagccattcagtaaagcgcggttcggaaacaacaatattgggtctgaatacccaaacaaatcctgggaaaacatcgggatgatgctgaataaggcttttcgcgatagtaaatagcacctgatgagaacccggtgaggtaagttcaggggggtgccaatcggcagtaattcccgccgccgcagacccctcacgccgttgatgataaaaatgaataatgtgctttattatcgcatcagtaaattgctctgccgtttcaaaaacatcatcaaattgaataaccgcacaggcattctcttcctgcacctgaaaataggttttaagcaaaggttcatcggcttcattcgcttgccataataataatttcgcttttttattgccggcaaacgttaaccagtcatcatgcgcctgcataaaacgacgctcaataggattacttacccctggggtttccataccaaatatccttcctgacaatacgttaaggatttaattttagaatgccaccttccacgatattttccgtatcaccgcaggatgtcactgttttagcttttatcgtatgtgtcgtcgatgccgcagaggtgatattaaccccggtgatttttatattaccggcttcatccataacaatactggaggcaccacattgcagcgtaatactggtgccggcggtgatagtgattgtgtcaccgacggttaatttatcgtgccccccaacggtggtggtattatcgccgccaatcttggattttttataaccctcgagggtatttttttgatatccgcccaccttcagtgtttggttagccccaatagtctttttttgtgagccgactacctcatattcctgatccagatctatcttggttttctgttttccagatatcagtaaccgatcatctgcttttaccgtcgtttgttgttctgctgtcacgtcaatgatgcgatcttgagtcacatcaatgcgttgtgtcccagtgacggtaatggtttggtcttgggtgatatccatggtctgattacccgaaaccgtcaccgcttgatctttggtcaccgtttcggtgtgattgcctgaaaccgtggtcgaacggtcattcaacaccgtggtattcatgtccctctgtgcccgcatcgacagctcttgcttgccgtcttgatcctcaaaacgcaattcgttatagccttcgcctttatgggttttcgactgtagcgccatctgcgttttcgccccaggcaatgctgaagggggaaggttattagcatgataagtgcgcccggtgacaatcggttggtccgggtcaccgtgcagaaaatctaccaccacttcctggccgatacgcgggatcgccaacatgccccagccttggccagcccacggctgggtaacgcggatccaacatgaactttgatcgttactttgaccatagcggtcccactggaattgcagccggatgcggccatactcgtcgcagtaaatttcttcgctcggtggccccacgaccatcgcgatctgtgggccatcagtgactggttttggcagcggcgttggccgccaggtttgcgtcggtggaataaagctgaactggttaaacaatacggtgccctgatcgccagactcttgctccagtgcctgcatctgtttaccggtatgctgaatgctgacgatctgccaggcatgatttaaatcgtcacgcgggtgggcactcaggctaaagagttgccccggctgcaaggtaaattcgttactttccccctgccccttattcgcatcgttgcgcagtgcctccaaccggtaacgggtaaaatccttgccatgttgctcatctttgaaacgcccagggaagtcaaaatgctcgtaatccggcctctgattctgtaactcgcgcgcttgttcactgaactcagccgcccatttgggatttttgaaggtgtagtcttttagctgtaccatcgccgggcgtacttgcgcgctgcgggtaaaggtggtgatgctcagttcctgcgcctgtgccgccacattcgggttatacggcagtgacgcccccttcggcagggagccaacatcatcggcatagaccacggtgtttttgcccgtgctgaattcgaagtagtagaaaatgccctcttctgctgtcaggcgctggataaaatcaaaatccgactcttgatattgcacacagaactcacgtgctggatgtgaatgacggaaaccgaaggcaaaatcattaatgccattctctttcaacagcgtagaaatgatggcctcaaccgattccaactggaaaattcgtgagttgcggcgcaaagaagtgcgccacagcgcggggcggatcaccatactgtagcgggtctggtgaaacccggtattgccctgttcaaagctggcaatcatgccagtaatactgcgctgtaaaataccttcgcgccagatagacaacgtcgcgtcttcatccaataccgcagaaaaatccaccgcaggatcggcactggccaagccaacatgtaaaacaaaaggtgaggagaatgcctcgtttaatgaaaaatcgacgacggcaaatgtctgaggcggtaaaccggcagcggtcagcgtaaattgtagcccggaaggtgcgttaattgctgcagaaatagcggctgtccccgttgaagccgagttaactgcactacgttcttttactttggctttattactgtcagcaaacatatctgctccatcctggaagttaatgcgtagacacggctaccgcatcagtgagaaataacggattaaacacgcactctagcgatgatttatcagcggccggtttattaataccttgacgtcgattaacggcgttaattcctatattcagcataagataatcaagaaaagtcttatattattctgattgggttaatcccatcgtctacgattattaaggcaaaagtccatagccatttattaatattaatcttacctgtgacaaacacctcaatattaatatgatcacaaaaaacaatacgcgttaataaacttattccgtatgaaaacaaaagattagtcgactggggcagaattttaaatcatttaagggcagagaatagagagagttagcgttggcaatgaagagtaaaatactatttatacaaatattataattttttatcctgcgtctgttttccctgcccgtaatagtggcattattttactggcgatttccttcttttaggcaggtcctgaatattaggttatttattagggtatcagtaccctcactgcatactgataccctttacacataaaaacgatttaccagctcacccgtgcacctatcgtgccgccgacggcataattgtcactgacattccgtgtagcccccagcagattgacattgccgtaaaccgcgtagcgaccattctgccattcatacgtgccacccgcgcctaaccccaccgactgacgctcatcccgggtggcgaactccacccccgagacctgtactttactgccgttaaggaactcattgtgcagatcgagatgactgtaaatgtgtgagcggcgggtggtgccgtctttcgcgctccaggtcgtttccttatccagtgagacaccaatgcggccccgcaggctgtcaccctcttgcagcgagacttcgctatcaaacggatcgcggaaggtatcgaaatcgacccgcgagtaggtcacctgcatctgcggggtcagtgacaacccgttacccagtgcgtaacctttaccggcttctatcgccgaggtatacccgcgaccattgttaccgctggccactgcatgccctgcggtacgggagctcaggtcgctgtcaaaccacatcgtctgcaactggccatccacatacacgccgttattgccataccaggtcaggctggtgccaaggccgtaacctgcgctgttgatgcggccatcaccaaagaatgagtggatatccgctttggcttttccgtaggtgaagttcaccccgccggtcagcagtgaaccgccctggctctgatacaacggcacatcaatgccggtctgcaacttccacacatcaatctcacgttgtgaaccgctggtggatcgggccgggtcggtgacctggtggctcccttcaatacggccccaggcccattgattatcgtcaaaattcaggtctgccagtgcgcccggtgccccgtaacggttaccgacacgctgttgcagcgtcggcagggtgttcagggcggccagcacctgcggatattgttcatacagcggcacgcccacctgatagcgcacgccctcggttagcatcagttctgacgagagataccagttgcggcctgcggtagcggcttccccgtcggcctgtaaggtgtaggcatacgccccggccaccaccgcctgatagccatccgtggtgacataatccccggccagcaggaaggtgtcatcctgtgccagaccgtccacggtgatcaggttgatgccattgagggttttatcgcccagaccgcccgcattgttcacccggaccgaggtggtgccggtggcatcgccgttgatcactaaccggtcggtggcagaatcgtcatcccccagcaccgtatcgagggccagccaggccccttcaccggaaccgttattttcaccaaaataagtcccggtcacggtcagccgatcatcggtagcggcaccattgccgccggtatagtggtttgacagcaggatcccgccagcgctgatgaggttaccgctcaggaccgagtcaccgagtgaggacagcgcaccgccttcagccagggttaatgcaccggtttcggtagccactagcgtcgggtcagcggcgatatcggcggcactgaggcgatttaatatggtggtggcaggcgtcaggcccaacgtggcgttatccagcaccaaaatccccccggcgatattggccgacaggaaggcattggcgtcaccgtcggccatattggcgccggttaacgtccagatgctgttgttggttttggtcagggtaccgaagccggtgatccggttcgggtcgccatccagaatggcctcttcacggttatcaatacgcgtgagatcgaaagcagcgtctcctgctccgcccagcaccagatggctgtttgccagatccaacgcggcatcattgatatccacgtaattgccagtaaataccagtgactgtgtcgccccttcaagggcatagccagattgcagctctaacgtggctgatgtttgaatgttatcaagccgatgaatgccaattgcggagccgttgccgccgtgcaccaagccgcccacagtgacataggtgtctgcggtattggtttcaagattaatcccgtagccctgctgcgaaaccagcgcgccccgggtgatcagatcaatggtcgatgtgccgttgtctacgcctgtgccattatccacgcctgtggtgttgttattgttatagaggtggatagcatcgtattcactggcgatattattgacgtcaatgttgaccagggtattgccgtcaatggtctgcgtattaagggttataccctccccatcactgacgttaatctggcccgtcacggtgacgtcggtggttactgtaccccggctagcctcagtaaggctatatatcccattccccattgaagtaatgtcattgacatggatgagcgtggtagcatcccccagagaggaataggtttggaacgttaccccttgtccccattccgcagcgagatgcccggttgcagtaatggcagaaagagctgaacccgaagaattgtaattgttgatatcaagcgattgactgctggaagtaatgttattcacattgatgagtatagtggaattgccttcaaaagtcgttcccatcactttaatcccggtaccgttttctgaagtaaccgtgcctgagacatcaaggtcaaacagtgtatttccagtttggttatagccgtaaatattgagtgcgtcatacagagaataaacgttattcaacttgatagcggtctcgacgttcccctcctccgagtaggtattggcatacagagcagatcctgaagtagccgtaagatcacccgtcaatataatatcggttacagcgccattctggctgctattatcgatataaaggccagcatattcacccgtgacattatttgcgcgaaatctaaggctcgaaagaccgctattggtatgattgtaaatcctggcagcttgactattggctgaactgatatcgccatcgatattgatatcggtcatcacctcccctgaataattgctattattaatatccaaggcgtcgaagtctgtactgatactctttgaatttaaattaaggatgctggtgccactattggaataattttggatcgaggctcctgaatattcgacgttgatatcgttggcaatatcaacattggtgatggccgttccgtaccgtgaattattatcgctttggatacccgcaatacctgaaatagcatggatgttcagaatgatagttgaatcattgtctgccaatgagtcgattgaaagggcaggagtgccattcaggccgctggataacatgccggagaggtctacctgtatggtcgagttgtcgcgactctggctgctaatatagataccactgccaattgaaccgttggcctgaacgttagtggatgtcgattgcccaatcatcgacgtatcattctggatagacaaagaataggcaccagcggtatcaagcgcagaactgttggtatcaaggtagctgatggcaccagagccgattaatgagagcgcaggatctatatctccaggctctatgatgccaaaaccgagctgggtctcaaccgtgatatccgttccacttaggatgatcccggcgttattttcaccttcacagatataggtactcccccccgaattgttgcacgacgcccgtgcggtttgtggtaaggcaagggtggagaacgcaacaataatcgccaatgtgatgggattaatcacggcgacaggagcgcggttgaagagggggtgacgcccgacatggctagaaataaattctctgaatggcataaacatagggtaccttattcattgtaactgtctgaatatatcgcagacatggcatatcactgaggttgctgagggcggtataaggcagagtacagaaggataaatttctcctcttgcattatctcaatatgatcagcaaacatgaggaagtgacgtgtgttctgtcggttgttgagtcactaaaacgaagttattgtttcttaagaggaatagtaagtgaaaaagaataaataagaataagacccgactaattctttgtaggaattttcttgttattgtttttttgaggattaataggcctgatggagattgttttaatgggaattgataacaactaacatttatttccataacgatttaattacttaaaataaatattgctgtttatttaatcttgcgtgttaattgttggcgacactaaataaatgatttattttttaacttaccgtttgttttttaacatgttatttaataaagcagtaatctaaaataggcgagtaacgagcgtagccaacgtatacgcaacttgaaggacgacgggtatatctccatggtaaagaggctgacaagtagaatattctccaggatgttgaaattctcccctgaataaaggtatcagtaccctcactgcatactgataccctttacacataaaaacgacttaccagctcacccgtgcacctatcgtgccgccgacggcatagttgtcactgatattccgtgtagcccccagcagattgacattgccgtaaaccgcgtagcgaccattctgccattcataggtgccacccgcgcctaaccccaccgactgacgctcatcccgggtggcgaactccacccctgagacctgtactttgctgccattgaggaactcattgtgcagatcgagatgactgtaaatgtgtgagcggcgggtggtgccgtctttcgcactccaggtcgtttccttatccagtgagacaccgaggcggccccgcaggctgtcaccctcttgcagcgagacttcgctatcaaacggatcgcggaaggtatcgaaatcgacccgcgagtaggtcacctgcatctgcggagtcagcgacaagccgtgacccagtgcgtaacctttaccggcttctatcgccgaggtatacccgcgaccattgttaccgctggccactgcatgccctgcggtacgggagctcaggtcgctgtcaaaccacatcgtctgcaactggccatccacatacacgccgttattgccataccaggtcaggctggtgccaaggccgtaacctgcgctgttgatgcggccatcaccaaagaatgagtggatatccgctttggcttttccgtaggtgaagttcaccccgccggtcagcagtgaaccgccctggctctgatacaacggcacatcaatgccggtctgcaacttccacacatcaatctcacgctgtgaaccgctggtggatcgggccgggtcggtgacctggtggctcccttcaatacggccccaggcccattgattatcgtcaaaattcaggtctgccagtgcgcccggtgccccgtaacggttaccgacacgctgttgcagcgtcggcagggtgttcagggcggccagcacctgcggatattgttcatacagcggcacgcccacctgatagcgcacgccctcggttagcatcagttctgacgagagataccagttgcggcctgcggtagcggcttccccgtcggcctgtaaggtgtaggcatacgccccggccaccaccgcctgatagccatccgtggtgacataatccccggccagcaggaaggtgtcatcctgcgccagaccgtccacggtgatcagattgatgccattgagggttttatcgcccagaccgcccgcattgttcacccggaccgaggtggtgccggtggcatcgccgttgatcactaaccggtcggtggcagaatcgtcatcccccagcaccgtatcgagtgccagccaggccccttcaccggaaccgttattttcaccaaaataagtcccggtcacggtcagccgatcatcggtagcggcaccattgccgccggtatagtggtttgacagcaggatcccgccagcgctgatgaggttgccgctcaggaccgagtcaccgagcgaggacagcgcgccgccttcagccagggttaatgcaccggtttcggtagccacccgcgtcgggtcagcggcgatatcggcggcactgaggcgatttaatatggtggtggcaggcgtcaggcccagcgtggcgttatccagcaccaaaatccccccaccgatattggccgacaggaaggcattggcgtcaccgtcggccatattggatccggttaatgtccagatgctgttgttggttttggtcagggtaccgaagccggtgatccggttcgggtcgccatccagaatggcctcttcacggttatcaatacgcgtgagatcgaaaacagcatctcctgttccgcccagcaccagatggctgtttgccagatccaacgcggcatcattgatctccgcataactgccagtgaagaccagtgcctgtgtaacgccttcaagggcatagccagattgcagctctaacgtggccgatgtttgaacattttcgagccgatgaatgccaattgcggtaccgttgccgccgtgcaccaagccgcccacggtgacataggtgtctgcagtattggtttcaatattaatcccgtagccctgctgtgaaaccagcgcgccccgggtgatcagatcaatggtcgatgtgccgttgtctgcgccagtaacagagttatggaggtaaatagcatcgtattcactggcgatattattgacgtcaatgttgaccagggtgctgccatcagtggcttgcgaaataagggtaataccctctccgttactggcgttaatctggcccaccacggtgagataggtggttgaattcccctcactcgctatggtgtctatttctacactactgcccgcagcagtgatgtcatttaaattaatgacagcgatagcatccccctgactgacataggtactgaatattgcccctaccccctgttcagagacgagatgcccggttgcggtaatgtcagaaacggcggttcctaaatggctatagttgttaactttgagcgattggctgccggaattaatattattcgcattgatgattatggtggagttaccttcagaagccatccccatcattaaaattccggtaccatattcgttaacaatatcgcctgaaatatcaaggtcaaactgcatgtcgccatttaaggtatttgcacttaaactgagcgcttcgtagtaagaatagatattatttaacttgatagatgccccgatgtcgtcctcttccacataggaattgaacacgagacccgcccctgaagtagacgtcagatccccggtcaacaggatatcggttatcgctgagctcttacggctatcattgctgatataaaggccagcatattcacccgtgacatggttcgcccgaagcctaaggcttgaaggaccctcataagcactattataaaaagtggcagcttggctattggctgaacggatatcgccatcaatattgatattggtaatcgccgccccagcataattcgtattataaacattcaagccatcgaattctgtcgtgatattttttgagttgaaattaattatgctggtctcgccattgccggtgttgttaatagaggcacccgaatattcgacgttaatatcgttgacaatattgatattagtggtggctattccactgcgtgaatcattgtagctctgcagacccatagaaccagacagagcatcgagattcaatatgaacgcagaattaccctcagccgatgaatggattgagagggccgcagagccattttggttaccggataacgtgccggagagatctatctgtatagccgcatcagcgccactgcggttgttaatgttgataccgctaccaatcgaactgttggactgaatattaatggacgtcgattgcccagccatcgaggtatcattctggatatacaaagaatcggcaccggtggtatcaagcgcagacctgttggtatcaaggtagctgatgacaccagaaccaattaacgagagcgcaggatccgcacctccgggctctgtgatgctaaaaccgggctgggtctcaacggcaatatcggtgccgcttaagatgatcccagcatgattttcaccttcgcaaacataggtgcccacccccgagctattacacgacgcccgtgcggtttgtggcaagacgagggcggagaacgcaacaataatcgccaatgtgatgggattaatcgcggctgcaggagcacaactgaagaggtgtcggtgccctgcatccggttgagcgggtgaggtagaaataggctctctaaattgtatatacataaatgtactctattaattgcctgaatttatcgcagacatggcatatcactaggggttgctgatattgcataattcagacaccaatagggtccagaaggagaattattccctctgacattatctcaatatcatcagcaaacatggggatggaagacgttctatcgtttgttgggtcactaaagtgaagtaaccatttataaggatagatagtaatagaaagaaaaaaaacaataagtaggacacgtctcgttatttgtaggaaaattcctatttaaaataataaataatcaaatcaatcacataaatattttatcaagaaaaaacatgaaaactaacatgtagcatgattatattttaaacattccctgctcagatcagatgaatactttacctgacacttaaatgatagggatgccgatatatgaagctgaatactgattcctgtgactaaaaagtatagattttccttaccctacgtcgtttcgagcgttttattttcgtgatttaatcagtcacattatctttatttaatcctgtaaaatgcaatattaaagatcaatatcattcatatttaaatgtttttatctatttagtatagataatatatgtgttatctcacatgaattaaccgtgtaaatattcccgtcatacttcaagctgccatgcgttggcgacgttcgttactcagctcatccaagagactcgcctctacgacgtcactacaagtcgcgttcaaatcgggttcaaatcgggttcacgatctatctgatgtttctatcgaatggaaaaaacggaggaaaaggagagcggagatgaattagtggataaatagcgcgagttatcccaaacgtttaatggcttagcgccccgtaggaacactaagccactgataaaacaaccaacaccgtaactgggtgtaaattgtcagcgatgatttgccaatgcttaagttgccaatgcttaagttgccaattcgcctacacgcgacaatggcagttagctcaccctaaactagacaaacatgctgatcagcagtaccaccgccaaaccaaccaccgagttggtcaattcgagcaggccccaagtcttcagcgtatctttaatcgacagctcaaaataacctttaaacagccagaatgaggcgtcattgatatgagtaaaggtgttagaacctgccgctgtcgccagcaccaacagtgccggatcgactgaggtaatggtcccggtgaccgggtccattaccgcagcaccgataatccctgcggcggtcatcgccgaaaccacgccttggcccgttgtcagacgaatcagcaccgtaatcagccaagccataatataaggtgatacaccaccagcagacatcagcatgccaatcgtatcgccgatcccggtatcaatgatcacctgctttagcgcaccgcccgcaccgatgatcaggatgaccatggcaacgccttttaccgccccttcaaatgagtgcatgacccattccattttatgaccgcgtccggtgccgaaaagtacgaaggcaaccaacatggcgataaacatggcaataggtgatgagccaatgaaattgagaatggtgtacgacgtggtccctttaaccaaccagatattggctatggtggtaaaaatcatgatgaaagcgggaattaacggtaccaaaatcgaggtactgaacgacggcagattattttcatcaatcgggttgtcagacttcaggaacgtcggaattggccgctccagattgcccaagaactttggcaaaataagcccggcacagatcactgaagggatcgcaaccagaaccccatagatataaaccatccccatgtctgcgccataagcggcaaccagcgcaaccggccccggctgtggtgggaatagggagtgagccgtcgtcgctgctgcaactgccgggatcgccagtttgaggaacggtatcttggcttcgaccgcaatagcaatgaccagtggtgccaaaataataaaggcaacctcataaaacatcgccagaccaaagatcaggccgatgataattaccgcggcttcaacatatttaagcccgaatcggcgcaatagcgtctgggctatctgatgagcagcgccagagtccaccatcagtttgccgatcaccgcaccaaatacgacgattatcgccagttcacctagcgtgccaccaaacccagccttaatggtatgcagcagcttaagcaggtccatgcccgcgagagtccctactagcagagctgccagcagcaatgcgaccattgagttaatctggtagcggatattgagcactagcattaagccaatacccaacatgacccacaggatattaatccattccatctcttgttttccccagtagttgaatctcagtattcttacttttgtatccgccgcgatattggtcggaccaaatttgattgtttttatggattcaaatttacctttagactggcaatacagtctaagatgccttgtcatccaagctactcagcctgtagaggcctacgctttggtattacagatatcactaagtggataaccaaatgaagtattggttaaccaagttgtcggacagatcgcaaaattaagatttataccctaaataaatcgagtgacaggaaggcggcaagcgagagacaaatgggtctggaacccatttgaaccgcatttatgttacccgcagggtgtggactcaaagatgaggttcattaatccccaggcgcttatttattttaaggtcaacaactttattttaagatcaacaacactcagtgattggggacagccaatgcgcatgccgcttgaagtatgacgggtatatacctaagaattcttctcattgaagccagtgtacagagagtggtgacctcgctgagggagatgatgacgttagatgacgaaaatcaatcgtgatgcgctatttcagtttcattgatggttagagacagcacgctaagaggacctacaacgttattgccacaagatggcgattttattcgccgtagagcattttcatgcgttagatctttttttcacaaagcactatttttcactattgcccgccctcatcaatttttcatttttcctctcatctaactaaattcaaaccaggcactaaattagatttttttaccctacagtgatcctgacgcaaaatgtgaagaatcattttatgcagtgtgggaaaacagaatatatatatatcctctgcctacatatttgtaagactattcagatttacactgtattgaataatatatgaccacataacttaaccttattaaatctcaacaatcccacctaaaaaaacctaacaaataaaaaataacacttaaataacaacaagataagtttaccaatcaaaaatgataattataaaaagcattaatatcttaattttagtaacatacatttttaaaaaatcaacataacctaaataattagtattaaacactgaattatggtgatttttagatcttttaaatcgaataaattaaaacaagcagttttttaccttaacagacctggcaatgcggctacatattgacatgatattttacgttctggcattacaggatttaatgttttgttaaaattgatttcgcgtgtacgatatttaacaggatagattaaaagacacattaacttccacaaggctatagcggttaataatttgatttaccggctgcttatatggcaataatcaattttatattacttatgctctaaataatttgagttacatgaaggcagcaaagcgagatggcataacctccccagaaattgacataagtcagtgactgggtgaacgaaagcagccaacacacatgaagcttgaagtatgacgagtatattagtttttatttctgtgaggcactatgttcagttgcataataaagacaacagacaattatttccgacacggcttgtttattttactcaaagaagccctgatggattgtcatgtcaacgctaatgcaactctcgccgatgatgctgattggcacaccaaaatggtatttattgatgccgactcgtcctattgtcatcggacactggaacaaacctatcaggcttacaagaatcaacaaagtggcacacctggcattttcattattctcaggtcaaagggggcacttttaccgctgaacatgtcttacaacacctccgcccatatcctctataaaagtgatgaacaagccgatattaaaagtaagattggggtggttataaaaaacgctcttggtcgaaaaaataccattaatcccactgtatgaataacctccgccagagactgactcgttagaaaaattaatatacaactgctttaataatatacttattatgttgaactcaaggatattctgtcaacggttaatctattaaccatatgagtaacaacacagtaactaaagatataaaatcaatgcaaatcaattgattacaaagaaagcatcaagccaacccctctcctgtaatatatatatatgttattaaatatgcttaactattaagcataaaataatataaatagttattttatgtaaaaataaaaagtaaaaaataaaagtcagtgatcaatagcatttttatttttcactaattacggtaggataaatctcgtttaacatcatataaaaaccaaaaacaatcccatccaagggagctgtatttttattttataaagatattcttactaagggaaatataatatgcgcagtaataacaaatttacattaaaaaaattggccctggcgttgatgttagcaggttgcaccataagcaacgcttatgccgtgctcattcccgtggcgggtgccatccagggaagcgcgcccaccttgagtgctccatcaaatagtgcgctgcatgccgtggacctgagcagcaatgcgacaggagcggtactggccagtggtgacaccatcactctaacctatacctacaacgacgctgacgaagatctggataattccacaaactatgtgaactggtactataccaaggggggtgtggatactcagattgccacgaccaatatcactaacagcccggctaaaactaacgatggcaaaggaaggagtgtgctgatcattcctgctacagcaattggtgcggatgcgatcaaggtggtgatacaggaattttcagcgtccggtgatccgataagcggtcagaccatttccgttgctgataccagtaccggtggtggtggtacgaccacacgccctggtcctatagcaccaggttcgaacgtgacaccagggatttacctgagcaccgataccctgtttaccaacaacctgcttggttcagaaacaattctgtccgcaaacaatgtttatgtgttcaaactgtgggacagcgaagccgttggagtgatcgatttaaccaatgcggtccattacaactggcgcttactaggagacagtgcgactgatagtgttgccgcaccgacaacgggctttgtaaccagtgtgtctaatgcagattttagtgttccaatgaataccgccgcggacggtacacaactgaccggttctgtcgatggtatgcagggcttccagttaacggtggattacaactaatccctgccgtactcgatggttactgatacaggccggttttcccgcctcaaactgctcccccgataagacaacgttgagctatgggtagaggcagaaaagtaatgggtaggcaaaagagtaatgggtaggcagaagagtaaagcgtccgcgccaggaatagcgtggctcaagcccccagggaaggggttaggcttattgaccatctaccggcgctctcagccgtggggacttggtcagtcatctgaaacagtgaccatttcggtctagcgaacaataaggtcatcactctccagccaaaaaaaccaatattcaatgcgctgaatgaatcaattcagataccgtagatacccaccgcatggcctctattcacccagtctccctggttgccaggcttgtgcttgctgttgtaatgaccataattcagcgtaaagcccttgatgctgaataagtgtcgaatggtccccttcttcaacaatctgcccgctatccataacaataatatgatcgacatattgaatagaagataatttatgcgcaatcaccagcacggttttccctcggattaaagcttgcattgccaactgaatatcttgttcattttctggatcgagtgatgcggtggcttcatctaaaataatcaagggcgcatcttttaataaagctctggcaatggccagccgctgtaactccccaccggagagatgcacaccacccgccccgatctcggtgtctaaccctgaggggagcttatcaagcaatggcaagagttgtgctgcacggcaaaccgacagcaactgctcattcgtcgcatcagggcaggcaacccttaaattattggcgatcgtctcatttaacacatagcttttttggaagactacgcttaaatggcgctgccaatagtccacatctatctctgcaagactcatttcattagctttatcgccaaccaatatatggccttgttcaatatcccaaaaacgtgcaattaatgatgccagtgttgatttccccgaaccggaaggcccgaccaatgcagtaatcttatttttctctatcgtgagattgagatgattaaatagcaatggtttatccggatatgcaaaacaaacattatccaatcgaatccgcatatcagtaatattaggctgtaaatcaccatgaacaagttcaggaatagcaaaaaccttttcgactcgctctacggctaacccaaagtaatttagctctgccaaaaacatcgacatgttgagtaaaggacggaaaaaccgtactgcagcaattaaaaaaatcaatacttcagacaaggggatcctcccccctacccagccccaggtgagtgcaaccaacaacacaataaagccgcactcaaccaatacattaaaactgtagatcggccagacaccggctttttctgccgttaatgattgttgataggtggtggttaatacctgtgataaccgctgaaaagcggcccctgtcatacggtaagcttttaactcttttaagccatcaatgtattccatcaatgtatcattaagtttaaacattaatagctgcatatattcctgccaacgctgggcataacgacgagtcaaaatatatgcgcataccgccaagggtaacgttgaaagcatggctaacgccatgcgccaatcttttagcaagagtcctaaggaaaagaaacagagcaccgaagcggtcgcaataatgggcgcatagagatgagtgaaaatattttcgatcatatcaatgtcttttagcagcgtattattgacactgctcatatccgaacggtagaaaaaacccatcggcaaacgtcgtaggtgctcaccaagacgtattcgaattttagcccctgcattgaacccaataattgcgacatggaagtacaggactctggctaatatcactcggaccaacatcaataacccacaaaatccagtcagtttaagttgatagatggcatcagggtgagaggacaacatatccaacacaatataatagagaaaagcatagggtagcgatgccagaaaagcatcaatgatggcaatactgaccatgcctttcaggccctttaagcggcctccggttaacgtgcttaaacctgataacttaatcataagagactgccttggcatccgttgaaaaatgccatatttttgcggcctgatgcgcagcccacatgttttgataaagggaatgggttgccagtaacgtttgatgagtgccctcggcgacttttctcccctcggccatcacgataatatgattaacgtgtattagcgtattgaggcgatgcgcaatcacaatgaccgttttgtctttaatgagatcagaaagtgcttgttgaatgcggacctcgttacgggcatcggcataagccgttgcttcatccaagagcacgataggggcatttttcgcaatagcccgagcaattgcgatacgttgtgcctgcccaccactcaatgtctcagggccaatgaccgtctggtagcgctcggggagttgttcgataaaatcatccgcacaggccgcttttgcggcgttgatgatttccgcctcagtcagtgaatcattccccatacggatgttattcatgaccgtatcattgaaaataaaggtgtcttgaaacacaaaagcggtcagagacatgagttgttcgagtggtaacatctcgatagggatatcaccaatacagatatcaccaccttggtgctcatagagacgaggaatcaactgtgccgccgtgctttttcccgcaccagaaggccccaccaatgcggttatctccccctgttttgccacaaaagataactgctcaagagtattttctttggcgtctgggtggcgaaaactgacctgattgaaacagatatcatagtgtttaatcggcagtggagtttgcccttcccgttgaggcttcgcgtgagcaaactcacgaatattctccccccctttgagtaatgcactgaacaagttaccaaagcgtaacaagttatacagtggttccatcaggccaatacccaacaacataaacataaaaatcacggctaatgtcacttccccttgggaaaaaagcatgatgccaacaggcataatgcacaataaaccgagatctaaagagagcttaaacaacgcggttgccgtgcgggtctcggttaaccactccctgaccagttgattatgtgcattcaccgcgttggtataacgttgatgggaattgaccgtcatattgaatgcttttaccaatggcatgcttttgacgaaatccacgatgctggtgtgcaaatcagccaccacgtgataataaacggtaatacgctgattaaatccttgaaacatccagcattgcagcaggcacgcaataggcagtgggatcagcgccaccagtgccaaacgccaatcaaagaaaaacagtaaaatggcggcagcaataggcgtgacaattgccgccgccatatcgggtaaatggtgagccacaaaggtttcaatacgcccaatatcatcagaaatgattttttttaatttcgcggtggtgtgctgatggctggcgctcaacggcaaacgccctacccgttcaatcacctgtcgacgcaattcaaataacaactgaaaagcggcctgatgggataacagcccggaggccaattgcaaaatagccttgccagccagcgcgagtaccgccatccccaccagccaccaaagctgagaagttgcagccgagggggggtaaagaaaattagcaattaattgatagattaaaacgtaaggcaccagtgataacagagagtaaccgaccgccagtatcatcgagagcgcgagtcgtttatgttgcgtactcagcagttgtatcaaccaccgaaacgcacttgcttgcgtgtccattaccctatctccacagtgtggcgatccttttggaaccccgcataagccgactgactacgacgaaaacaatagagggtcaataaaaccaccaagaaagcacagacagtggcaatcccaaaggcataggtgaaccccaagtaataggctaatgtgccactgagaaccatcgcaatactgccaccaaggacttcacaacattgcagcaaggtaaaatcagtacccggctgaacgataccttgatcctcgtcaccttcgctccaacacataaaccacgcaaagatcgatacacaacaaagattaaaaaagaaaccttccagaatgaaaaagacaaaaacaggcaatgaattgtgagcggaaaaagagagggataatgtcatccccaaccaacacaacatactccccaataagccaaaaaccgtaagctgtgggctggaaaaccagcgatgtagaacgccggataagatagcgcccacgatatagctgataatcaagacccctcctgccagcagtgctatttgctccagacttacgcccatatccactaataatggggaaaccaaagcggcccccatggtgctggcaaatttgaaggcgaccgccataacaacgattggcacccaacctttacggcgaaatatcttccacagcgatgcactgccgggtatcactggcaatttattttctgctgcaaatcgccctagatgaaacataaaaggaagatgacaaagcacctgtaacaacaaaaaccaccacacggtgacggaccacccccaaacactgaaaacatacaaactgacgacaccacctaataacatgcccaaactaaaacccgcgatttgactgacattcacacgaacgtggcggctcccggcaaacaccctcaccgccagtgcatccacagcaacatcttggctggcatagaaaaaattaatcaacgtgaccagtaataacaacgccaagacatgtgtctctggcgcaaaaaaccatagcagcgtcatggcaatcaaagagcacactttacagaattgaatccatgctaaaccggtgggtaagcccctaaaaaaccaaggtttatggttttcaataaatgacgcccagagcattttaaacgcccaaggcagcatactcagccccaccaaaccaatcagccgcatatcggcccccaaggatcgtaaaattcccggtagggcaaagatagccaacccgaggggaacaccttgcgcacaatacaatccaaataaactggtaatatttgcgttatatttcatcgtgatactccttgcattccttgcattccttgcttgattgctgcgcggcaacagactggttgatgaatgccaataatcttttttgggcatgattaagataaaaatgcccaccggggaacacctgtagccgaaaagcccccttcgtcacctgacaccactcactcatttgcctcaccgacacttcggtatcctgctctcccacgcaggccataaccgaacaattcaacagttcggtacattggcgctggtaggtctctatcgcggtgaaatccgccctaaaaataggtaatagcaggtctttcagttctggctgttggtagtccaatgtgctgccacccaattgggtgattttgttcaagatactcacatcactctggcggtaaaaatccgtatcggtatttttatgcggaggtaatcgcccggagacgtacagcgtggtaatgcctcgccccgccttttgtaagcgcaatgccacctcaaaagccaaagcggcccccatgctgtggccaaagaaaaacgtgtcacgcacaggcaggtaaacataactctgagcaatgacatcagccatttgatgcaaattgtgcaatagcgattcgttaatccgcccgccatgcccaggaagttgaatggcatacaaggcggtgtccggtggcagatccgttttccacggcaaaaaatactccgctgaaccacctgcatggtgaaaacacaccatttgctgacgagttcccggttttatcaatcgaaaaaggcgttcaatcatcacgctctccctgccattgagataaaaatgtcgccaccttaggtgacgccatcatcggttcggcaaaatgcacactttctggattgccgactttttccataagtgttttccatacttgtgttagcgagagcaggaattgcgcataagcaggtgacgaatgctgctgttgctcgataaattctcgcagagcatgacgtatcgccgagggccactggtggtgcaagacgcttaacagattgtcactttcctgtgaaaaaagttgactcagggggggcaaaaaatagtgtggagcgtcatcggggtcgataacctcacgacagccgaaaggagttctcaccctcggaatatgaaaataggggctccagataaccggcccatgtgtattgaccaagagtagattgccactaggtaaccccacacacaggcggtgcatgatatgaaaatggttatcaggagcggctgggtctaactgattttgcaaatttaaggtaagggggacacccgcaatcacaccctgtagctgggtatatggcgcagggttttccagcagtgaacgcagtaacacgtcaccgcctgccacgctaaaaccataaggtgaaaaatgcccccccaatacacgcccgatgatatccagcagcccgcaaatgacttgaaccccgcaagttgcctcaataaaacacggtttttgggtttgcatggcctcgtgcaaataggcgataaattggcgtactgcgggcacatggggataatgcgtattcacctggtaatggcagccctgttgacgagccaacctcaggcactcagccacatcttcaagacaaactggatgctcttgtaatactgaaatgccccgttttaataacgccttcgtgatttcactgcctttcccccccacgatagtggagcggatcaccacacaagccatatttatatcatcaggtaattcatcaacatgatgatatagcgggacaccataggcgtgtgctaattgcctggaacgctcacttccttgtgcgagaatgcccgccagttctcccccctcaaaggccgtcttaaaggcggagagataaacctgcccaaataaagtgccgcagaccacgattttctgaggttggatcataatgccccctcctgaaaattcactgcgttattatcgagttgacagtggatatggaaatgactgaataaagccaattcattaagttgtgacagcaataccttgatgggcagtaagtccgttaaccaatacaatcccacacggtgggtacataacacgtggtgggcggccaaagcagcaatagtgcccgtcaattgatagctgttcgtaaagcggatttgaagttgcaatgcggcaggctgcccggctaataaccccttcgctaccataaagagatgctgttgctccccctcttgcctcgtcaattgttggctaaaggctatcagtgtttgagccgccgcccccccttccccgccaagcccaacgagtaagcgttgatcggcgatcaggttataagcagcaagatgggagagcgaatgcacggtgaccagccgctcatgttcaaaactgaaataaggcagagcatcaaatagccgttgtgctgttggtatcgataccgcttttttcagactctctttacacaaccctccgtcataccacacataaccgcttttaccctgtgcccagcccgtgtattggctggacagaaaatcgtgggcagaggtcggcgtaaaggtctcgatacctccgctgtagaccgttagctgagtcacaggcgacaaacagtcaacggcataccgcggtaacatggcggccaatccaggaataaccccagcccccaatacacaggccgaggaagaggccgccatcggcactaataatgttcgttcgataacaggatcaccggccacatccacataatgtttcccctcggctaatgccgtcagggcaatatgcgcttcgatatcagaggcagggccagcggcgtttagcactaaatccacctgacggcagctatcagcaagggctttatgatcaaagagatcgaatacaatatgatggggatgattaggatgctcccgcctcccagcggtgatcactcgataacctcgctgagacaattgcgtgacagccgcttgccccacggccccctgcccaccaaccaccaaaatagtttttggctgtctcatccccgcactcctttgcattgttcaagatgctgaatgagtggcgagatattatccgccgacaggcacgtaaagtgatcgcctggcaaggtgaggcggtttatctgcccaagacagtaagtttgccaaaatgccgtcatatcttgttgtaaagcaggcagaaggtaggtatccccctgttggcaaacaaaagtcatatccccggcaaagtagtttggctggtattggcacacgccttggatactgtggcggaacacatcaaacggctggcgagaaacgtgggacgatgctgttgagtgctgttcaattgccgttagcaattgtgataaacgcacctcattagattgttgttgaagacaggcgtactcatttgccagagcggttaacccattcgcttttgcacgttcaacgaccgcattcacggtaatcaccgccggtttgtcggccaaaatggcgtgataaataccttctaaatcagccttcagcaaattccagggaggttcgacacctaacgtccaactcatcaccaaatcaatcatcaaaggatcgttgatgtgatatggaatttgatagctactgataatggtcaacgaactcaccggccttccattttccaatgcctgccgggcaatttcaaaagccagtagcccccccatgcaatatcccactaaatggcactgatcacccaccttctgaatttcaggtagataggtactggctaactggcaaattaatctttctgcaggaatcgagagaaaagcggcgctgtcggtaacattgaccccataaatagggccagataatttatcgactaaggatagatacggtaatacggtaccgctcccttcgtggaggatgaccaccggttcctctgatctttctttcaaacccgatctttctttcaaacccgcactttctttcaggcacgtcaccgccatttgggggcgctgactctcgggctcttcctcccggatattgcggagataagccgccaatgcccgcgcggtaggttgctgtaaaacctgccgtaggcacccctcccatggcaccttatcttcacccaagacttctcgcacttggttaatccactgagtaatcagcaatgaatcgccgccactggtgaaaaaatcatcatcgacacccatggcattattccctatgagggtacgaccaagagcaagcaacgtcttctccagtggtgaatccgtatcctgcagcgcaggggcttgcttttgttggctctcaggtaaccgtggtagctgtttgcgatctatttttccattggcagaaaccggcaatttatccaatatgaccagtttagctggcaccatatagtccggtaattgttgctgcaaatacgccagcaaggcatcaggttcgcaagacatacgctggctattaaattgcgcaaatataaaactttgccccattttatgtaaaacatcatccgtgggtggataggcccatagcatttcggctcctacatcctgtagtgcatgtatccagttttgttgtggcaaaaagggagagtccaatgcaagacgctcatcttcaaacgccgttaatccctgtttaaattccatggacgtcatcagctgataattgtcccgcgtggcttcaatgattaacaaccaaccaccgggtgctaacagttgacgtaagttattcaacccgtgacgggcaataatcgcgttatgcaaaacattggcagcgaccactaaatcatactgtccgcaattaagcccttgctgtactggcgactggttaaagtcaaacagttgataatggataaagtcataatgttgataacgttttcgcgcttcatttaagaaaaaaggcgagatatcagtgaaggtatattccgcgttcccctcggcgaatagagggatcaacacattactggttccccccacgccggccccgatttcgaacacctttaagacccgcccttgagcctgattctttaccttctgctccgccgccttgagcaacaggcggttcataaactggctaatgaggttgttttgataagcctgtgtcgcgacgtcaaggcggccatcagggaaaagaagattgaggggatcttctttgccctgtaagagttcaggtaaacattggctgctacgctccagataagtgagcaaccccctattatcatcaagctgtgtaatgagttgctcacattgctgccagcaaagcctaatctcctgctccgcgaccacactgattaagcgataagtatcattaatttgttgaagatattggtgctgtgtcagcgcccgcaaccaacggcgtagtaattgacgatttaccgatgcgatttggcctttttccataatggcatccagtgtcacagcatgatgtgtattcactgtttgcatatctgataaggctttaaccatctgcattaatgccactttatccagtaagctgaataacctgtcgatacacggcctatccagtgcatcccccgcttgttgagcagcagactgaagatgtgccagtgcagtgcgcccctgttcccgaagtgactgggtatagtctgaagcagcagcaacctgtgccacctcgatataagcctgcaattctgtatgtgtggttggtgtggcttgtgcgatttgtgcggcttgtgtggcttgtgcgatttgtgtggcttgttcggcttgttcggtttgtatagcttgtgtggtctgcatgacgacagcctgcgccacctcaggtaatttcaataactgtgcttcaatttcgcccgtctcaacacggtagccacgcactttgatttggtggtcacgacgccctaaaaattcaatgacaccttctgaggtataacgccctaaatctccggttcgataccaacgcaaaccttgcgtatccatgaagaaatgcgcttgtgttttagcctcatcctgccaatagccttgagcaacccctcggcccccaatcaacagctcccccgccccccaatccgggcaatcctctccccaagggtttactaccctaaattgttgattggttagcggaacaccataaggaatactgacggggtaggttatttgcggatctatccgccagtagttcgaccaaatcgccgcttcggtcgcaccgcccaatgccaattgagtacaatgtggcgcaatctgggcgatcgctggaggtaagttaacggggatccaatccccggaaagcaagatataacgcagtgatggcagcgttatctgctcggcccgcagatagtccgttaacatcttcatttgtgcaggaaccgagttccacagggttatctggtgctgggcaatgtcatgcgcccaacgagccggattctgtcgatcgccctcgtcagggaaaatcaatgcccctcccgcgcccaacacaccaaaaatatcaaaaacggatagatcaaaacttaagcgcgccaatgccagcacgcgatcatcaggggtgagggccatcctctgttgcatatcggcaagggtgttataggccgcatcatggctgatcatcacgcctttcggttggcctgtactcccagaggtgtaaatgacataagccagatcatgaggcaagggcagtatttttgcttcaatggcatcgggtatctgtgctaatagcgacagattgatctccctaaaatgggcatcagccaaacaggcttgtggcgatgccgtcaccaccccactgaccgccgcatcggacagtattgttaaaatccttgcgggcggttggtggatgtccaccggcacataggcacttcccgcgatgaaaatccccaacaccgccaccacttgctcatggcgtttttccatcaataccgcatagcgttggtgactattaagtttagcggccaacgcctgcgcacgggcgattaaggccgcgtaagtaaggctgtgttgtggatccaccagcgcaatggcctgtggttgctgtgctgcgcgggctaatatcccatcatgaaggcaacggggtgtcagtgttttttccgtagcattgacctgcttgcgccgttgctgttggctctcgggcaagggtaacgataatgctgaatgccaaaacaagggcgagtcacaaagtgcctctcccgtgtcgacctcctccatacagaggcacttaacacgatcaatacactcaatactgtcaatacactcaacactgtcaatacgctcaacactgtcaataaaagtagaaaacatggcggcgacgacgcccttggggaaaacatcggccatcacatcccaatttagctgtaacctcccttgtaacaccatgatttgacaatcaatccagacctgcggcgtttggctaataccatagtcgaaaaccagatccagttgagtctcgctgatcgcttcttgtacctgatttttgccctctccgactaaagcactggtgaaaacgatgggcattctggcgtgccccacgccttgttgccgcccccattcacgcataacttcaatgccagaaaatgttcggtgttccagatcttgccaaagctgtttctggatctgtttaactcgctcatacaccgtcttgggtgagcgtaaatcgacttccaataagctgactgaggtaaaatcacccaccaatttgtcgatatctttatgaatattgggacgattcattaccgtgagattcaaggtaaaatggcggttctccgaccatcggccaatcacttcactaaaaacagtgagtaaaaacgctgacggtgaaacaccttgttgctggcaaccttgctgcaagcgccgccaacatgaaggagcgagttgatggcgataacggacaaatcgcggtatttctgacgcgtttgtttgcatggccggtgatggcgaacctgtcggtaactgtacacatgtcggtaattgtggacatgccggtaacgtagggagtcgagaaaaccaatattggcgcgcatcaccataggcacgcccactctgttgctggcgttcatagcaaatcacatcgcggaaactcgcagtcagtggcgcggtggggaaagtttgtccgagataccccttgaataattccgccagcaaaatctgcacgctaaggaaatcagcaatcagcaaatcaatactgaaatgcaaacaatctttaccgttctgatgactgattttgagatcaaacaatggccatttatcggtttgataaacccgatgagacatagcctgacgcacggtttctgatgaaacatcaacctgctcaatcacgaaaggcgcgacagaaggcaggatacgctgctcaccatttggcgtgataatggctcgcaacatatcatggcgaataatcatctgttcccagacgcattccagtttagccttatcccaacaaggtgcgaggatctcaaaatagccatgacacccaaccccgccatattcaaacacgctctgccgcccaacaaaataagcagcctgtacatggctaagcggaaaagccgcataacggttttctgtatcgataggcagggtttcttgctgctccctcacggctaaaattgccaccaactggggtttcagcgcttttaaggacgcaatcaccgcccccgtcatgaccccttctggcgcacgaaatttgatcctttcaccctctaaccagaaacgaacctcctgttgttcaaggttcacgagtagatcggtggcctgtgttgctgaagatgaacccatatttatatccataatgattcctcctcaaattgagtcttccacaaattgaatacgcccttcactctggtgtgcaggctccataactaaagcaatttgtgcgattgtctgtacgctgaaaattttccacagtgggagttcaaccccatagtttcggcgcaatacggatgtcaggcgaatggcaataaaggagtcgccgccaagcgcaaaaaagttgtcatgagattgaatcgacgctacattcagcagtaactggagctgctcgcacagtaattgctccatagcagtcatgggttgggttacctgaggtgtttcggtcggttcgaaagacggtgtgacgaaggcacggagagcatgctggtcacgtttcccgttatccgtcagtggccatgcgcagcaatgccctaaccgggaggggatggcatactccggtagccgctcgcgaagaaatgcggtcaccgcctgccaatccaggggggttggcgtaacagcaacagccgctaaaacagggcggtcattgtgttgaataacaaaagcgaccgcatcctcgatcgaaggatagctttttagggctaacgtaatttcgtctagttctacgcggtaacccgagattttaacttgctggtccttgcgccccagaaactcgatgatggcgtcagggcgatagcggccagtatcccctgtgcggtaccaccgttgcccatcgcgtaggataaattgctgttcagtgccggcgctatcgccataatagccctgtgcaaccccttgccctccaatccacaactcacccgccacccagtcagggcaatcctcttcttgctcattcacaattcggaattgctgattaggcaatggcacgccgtaaggcaccgagcaccacccggtcagcgctgtatctgctacccaataattggaccagatagccgcttccgtggccccccccatggcgacacagtgagcatttggcgcaaaccgccgcaggtgttgaggcaactccggtactatccaatcccctgagagcatcaccactcgcagcgagagcaacgctggcggctgttcatcctgttcattaaatatctgttcattaaataacagcatcatctctaataacgctggcacactgttccacaccgtcacttgatgttgttggaccagtgataaccatattgccgcctctcgctgtgcctgctgcggaataaggactaacctcgcgccggcagacaacacaccaaaaacatcccaaacggagaggtcaaaatacagcgctgataacgccaaggccgtatcttgtgggttgatttgatgctgacgattgaccgactcaatggtattgaccgccgcgccatggctaaccgccacccctttagggacacccgtactgccggacgtgaaaataagataagccaggctatctgcactcactacccgtggcgtggggcgctcgtcagaaaccggatcactctccaccgaaagcacatcgacctcttccggccagcccagcgtgcgatcaccaataaggaaatggatatcagccaaagtgataacctgtgatcggcgacacgcgggccattccacattgataggtacataagccgcaccgagccactgaatcgccagtaccgcaatgatctgatcacaaccccgtggtaatgccacaccgacatgggcactttctctcaccccttgctcgtgtaaatactgtgcaagccgttgcacagcgtgttcaagttgttgatagctgaggcggctgcccccccaaattaacgcggtctgctgggcgtatgccgccatagcgtgcgcgacccgacagtgcataggcgaaaatatcatcgcttgatgggtcgcatttaccctctgccggctctgctgctgcggcgcaggtaacgcaatctcaacgctgtcatgccagtgctctgtgacacaaagtttttccaacaattgacagtaagcggcgaacatggcgtcgatcacgccagctggaaataaagcctcaacgacatcccagttaaaatgcaattcgccatcacgttcgaaaacctgatggtcaatccacaattgcggtgtctgagaaatcccccaaagaggggcttggaatgcgctgtcagggtaaccatccacttgtgcgcccaaggcactggtaaacaccaccggcatgtgaatatgggttgttccccgctggcgatttaactccctgagcacccagacggcggaaacttcacggtgctccagatctcgccatagctgttgctgaatacgctgagccgttgccaaccacccttcccctttctcttgtcgacaacctaataagagcagagaagtaaaatcgcccataatatggttaatatctggatgacaaggtttgcgatcaaacaaggtgacattgatggtgagtgatgctgattcagaccacttcgccaaaacttgggcatagcaagccaggagtaagcaagagggtgtaatttgatgctgtttggctttatgcaataacatctgccaatcagaggccgacaagacagcttgccaacgcttaaatttaggcgtgcccactaaggcgggatcgcacaccaatggcaagcgcggtgcatccggtaacattgggagactttctcgccaataatcctcagagacttggcgatgaggtgacgatgattcagcgagcagataatcgcggaaaccaatctccacggagggtagcgtggcggtatggtcctcatacaagacagccaactctttaaagaagatctgcatactcaaaccgtctaacaccagattatccagcccaaggcaaaaacgatttctaccctcatcagactgaattaaggtcgcgtggaacaacggccattgggtcggttcagagacatgatgtgacaaccgatcccgttgagtcgccgtcacggtttcccactccacagcaccgcaatgaataacctgaagcgccggggacggttgatggggtaacacacgctgtgtaccctgttcatcaaacacaatacgcaacgcatcatgacgagctaccagcagagttaaggcccgctctaatcgttcccggtcaaacggtgtgcctttatattgctgatggctttcatgttcctgatattcgtattcctgatattcgtattcctgatactcgtattcctgatactcgtattcctgataatagtgcgttgccacgccacccagtgggaaccccgattgccgccccattaaatatgctcgctgcacatcggttagctcaaagggcgaataacgttgggcggcacaatgaactaattgcgcctcctgtacaggcgcatggcggaacgccagactgtgagcaaaatcccttaacaccggcagtaaaaatacctgagacaatggcacgccaaccgcgccctctttttccaacaaggccacgatgcgcgtggcatgcaggctatcaccgccacacaggaaaaagttgctatctgattgcggcgtaacccctaacacttgctgccaaaggcgagcgacgcactgttcttttttatcagacagttcttttttatcagacagttctcgtttatcagactgttctcggttatcagaccgttcccgttcatctggcggcttctgttgggcagataacacgcgaggcgcttcaccatcatggcttagctgcccatactcaacggcctgtttatataacgatgtccggtcaattttgccgttcggtgtcagtggcaatgtctccagtaccgtgatagacgatggcaccatataggcgggtaaatgttgctgtaaatgttgctttatctgttcacgcgaaacgggcactttcgttatctgtggttgacagacaaagagtgcagaatacggttcaataatactgagttgctggatggcaatacctgaatccgttaacaacgactgccaggcgggtaaatccaagagcggcgaaagcgccccttgccgttgatccctaaaaccattgggatgttgtaacaacaacaccgttaatagcgacagtgggcttagtgccaggctttcaaacaggacaatttccgtccctccatggcaaagggattgcagcatagcaatcccctcaggcagggcatcaaatcggtgtagtgaattattgacgatcagaatatcggcaagttgttgctgttcatcgggtgttgcaatcacgtctgtttcatgggaatagccagctaaacgatactttgcgtgttgacgcaatgaattcgcagattccaacaaacagtaactcagcacctcagttcccaaccggctcaatacccggctggcaaacagccccgttcgcccattcaattcggttacattaacaggccgttgtaattgccgagataaacgaacaatgcgctgacatagcacatcaataaccacttgggcatcatgcgtattggcggctaaaacttctggcgacaggagcgtgtcgtccaacaataacagtggatttccccgcccagtcactacctcgccgatccatgacgctttttgctctaacgtcatcaagagcggtaacaggtgtggttcagtcacctcagggcgtacgggctgaattcctgcggttttaaactggtcatcgcgagaaagtaaaaccccttgttcaaccaaccaatggagccaggctaaaaatagaggttggtaggcttcgctaatcccccctttttgctgcaatacctgcgtagactgagactccgccagatcgagcttgagaacattgctgagcacatggcataacagaaaagtggttatcgcgttttcttgctcacgaatatccgttacaagtctggtttcaggtaatacatcatcaacggttgcggagaagagagtgggtacctgattctgaggctcaacaaacaggtataaatgcttttgtggctgatccaaatataaaaccaccgcacgtttaatcgttgccagatgctctgcgacagcttcaatttccgctaattcaatgcgataaccatgcagttttatttgtctatcctgtcgccccaaaaactccagacacccattaggccaaaagcgaccataatcgcctgttcgataaaaacccgcgcgatgaacagagacaaattgcgccgccgttttttctggctcccggtaataacctaacgccacccccctaccgccaatccacagttcccctgtcacccaatcagggcaatctctgccagcctgatcaacgacacgataatattgatgggccagtgggtaaccataaggtatggatacccactcctcagggatcactgcgatatccagcgcattagaccaaatggccgcttctgtggcaccacccagcgcggtgaaacgtgcttggctaccaagcgctctcagcctggggagcagatctaacccgatccaatcccccgacaacaacacctgttgtaacgaacgaggcaaagcttgcgtaccttgctcagcggcgatcagcagcatttcaaataaggccggaacactgttccaatgtgtcacttgatgttgatgcagtgctgacagccactgtttagcttctttttcatcgcccgcgttgggcaataccagggagccgccgacagacaaaggaccaaaaatatcataaaccgagagatcgaaatttaatgccgagagtgcgaacaagatgatcttcccatcatcaacatagcggcgattaatctcatcaatcgtattcattgccgcctgatgtgtcaccaccacccctttaggcacccccgtcgagcctgaggtaaaaatcagataggctggctcatcaggttgtacaaaaatagagggcgtaaaaatagagggcgcagcagcagatgaggtaaaaacagacggggtaaaaggcgatggaaaaccgcctgttatgttgatattcactgtgtcgcagttagcggatatcttgtggtcgctaatcaagacgccaatatccgcctgcgcgatcagttgctgtaagcgttcggggggcgcggtaatatccaacggcacatacaccgccccaatggacaataccgccagcaccgcgatcacttgatcaatgcctttaggtaaacaaatacccacatgaccctgtcgtgccatacgctgctgtaaatgccccgccaaatcgccgactcgtattgccatttccctatacgtcaaagtgtcggaggcattgatgacagcaatgttattcgggactaatgcgacttgctgccaaaagccctgatgtaacgtttttgcctcgaaaggcaccccattgacacccgataacggcggttggcgatgcgccagcaccttgtcatccacatatgcctgaacaggtgactgtaagacttgctcattctcaacaatggattgaagaagctgctgcataaaagcaaacatctgatcaagcatcccttcggggaagagtgcgtccacggtatcccaactgatcaacagggctttctgatactccatcacctggcagtctagccacacttgtggtgtctgagaaaccaaatagtgcagcgcccccggcgcattttccccgagtaattcacgcccaagattactggtgaagacaaccggcagagtaacctgttcgccccgcagttgagaccactgacgcaacacgtgcactgcgctgtaatccccatgatccagatcagccataaactgctgattcagcctgcggaaatgatccagtaaactttcgttttctttaacctcacatgccaatatgagcaaggacgtaaaatcagcgaccaattttgccaattgtggatgtgcgccacgacggttaaaaatcgttaagttcagcgaaaagtcaggcaatttcgcccaaccccgtaatgtttcagcaaaacaacccgccaataacatggagggcgttaacctatgttggcgggctatttgttgtaatttagcccaatgttctgccgctaaacgccactcacggtgttggaaaataggtttatctatctgctccggttttattgccaatggcagttgcggtgctaacggtaaacctgcgattaaccgttgttgccagtaagcttcgctctcacccgttgatggtgttgatttttgctccaacaaatattgcgggaagtggtaatccaacggtgcaaatggcgtactctgcgacgaaaggagcagccctagctcctccaacagaatttgcaaactcatggcatcagcaatcaccatgtccacattaatgtgcaaacgggtgttttgcccatcatggctggcaatcaattggaacccactctcgtcagttaaatcagccatacgatgggataaacgcgcccgtagcgcgtagcgctcctttgcacaagcccttgcggagagctgatcccagtgatattgcgttaccgtcacgggcttgatttcctggataacccccatcccttgctcattaatgcgcatacgcaaaagctcatgacgatggaataattgcgtcaccgcctgatgaagacgttcatccgctaacgacgggcaatccaactccagataaacctgacaggcaacctgccccaacgtttgccccttctgacgcccttgccaataggcttgctgcacaggggtaagcacaaaaggctccccctgccagtactcacccacagtttgctcttctgtgagtggggtaaccgcaccgacaccctccccgcagacaccgcttctacaaacactgtcccaatactgttcccatgctcccagggttgttttttcaaacaaccttgccaacgtcaaagtgatatggcgttttttacactcatccaccagatccaacatctgcaaagaatctaagcctaaactcagcaaatcatcctcatcagataacgctccagacgcgatagcgagtgtctctgccacccaagtgcgcacaaatgaaaaatcaagggtgtcgaccataaccgaaggggaggataagggggcactctctgccagcagaccttcagcccaatagcactggcgagtaaaaggataaagaggcaaaagcgccagtacctcagcactgacggccccttcagagggggggactgatgcccagtcaaaaaaccctcccgccaaccattgtttgggcgattgcgccttttcaaagcgacagcggggatcatttttctcgccggtgacttgatgtaactgtgcgattaaatcacctaatgagtgatattgaatcaaggcacggatgggaaaatgatggctacgtttagtgcgccacgcagcgacaatcgcccgagcaagcgccgtatgctgtgacaatacctcggcaagctggcgcgccgtcgccaagagtgcggcttcagttttagcgctgatgggcagccaaccaaccgcctcctcatcggatagccaggttgttgatgcaactggttctattgatgcaactgattttattgatgtggctgattttattgatgtaactggctttattgatgtaactgattttattgatgtggctgactttattgatctagcaactgccgtaggctttctcaacacggctgcagccatcgttccggtaaagctaaaagcattgatggcgacacgttcgattacccaagggcaggtatctttatcgaaataataacgtgataacttttctgctatcagtgggttatagatatttagcgtggggtgaccaaaggctttctgttgttgtatctgcgcgacagccctggctaatgcaaatccccccgctgcagcctccaagtgcccaacctgacttttactcgcccctaaacgtaatggcgtttttcgttgaccatagacacgatcaatggcgcttagctcaacgggatcccctaacgaagtgcccgttccatgggtttccaataacgagatatcatcgggagccaatgatgctcgctgtaaaagctgcgacatcatagccgcttgagcgtgtggattcggtgccgtcaggctgctgctctcaccatcctgcgcaacgacactgccctcaataatcgctaagacaggatcgccatctctcacggcttgacgataaggttttaacaggaataataccgccccttcccctcgggcatagccatcagcatcatcactgaacgtagcacagcgccccttgggtgataacatgcccgcattgataagagtttgttcaatttgtgccgataggagtaaattcacgccccccacgacagccgcgctgcactgtttttgctgtagtgacaacatcgcgctatccagtgcgaccagcgaagaagaacaggcggtatcaatggttaatgccgggccacgcgtgccatagaatttcgccaaccgcccagatgtcgcactgctacaaatccccgtcgccaaataacttttggcataatcggggtcatttttctgtaacaacatttgcccatattcgctgccactttgaccaatgtaaaaaccaatatcgctttgttgcaactgctcaggttgccagcctgcctgctcaaacaggtgccaactcagttctaaaatatgacgttgttgcggatcgagtaagatggcttctcgttcgctgatattaaagaaagaagcgtcgaactgatcaatgtcttctaatgcgcctatcggtaaaacacagtgtcgcagtcgattgttttcatgacgtactgcgctgttacctgcggataattctgtacaatagtccgcccagctcacccccacctgccccggtaagcgacaactgatagccacaatcgcgacatcccgatcatctcctgcttccgttgaacttgaggaggcgatatcttcttggtgctgagataaaaataaggtcagttgccgtaatgtaggataggcgaagagatctgcgacattgagatgacagcccagaaaatgattaatacgctgacaaaattgtgtcgccagcaaactggttaaccctgcctgatgtagcccactatcaggattgatcgcctcacaaccgagtaattcacaccctgttttatggagccaatcaaacagtatggcctcctgctcaaataacacgctttcttgatcaaataacatttcatcttgagtctctgcctgcgacgccagtacataaagcacgctcaattgttgtgtgaaatagagagaaagcatatgactgcggcggatcttgccactcgatgtttttaagagttttccacgggcgagtaagatgatcgtgtcagatttcagttggaaatggcgggctaccgtcgccacaatctgctgagcaatacgctgcagtgccgttgatgttaaatgacgatacacctcggccatcacaataaattcgccactctcaaaatgctgacatacacacactccccccgtgtggatatcatcgcaggcgtactcaattgctgtttcaatatccttgggcatataattttgcccagccacaataatgagatcttttaatcgcccacaaataaagagctccccttgatacacaaaggcaagatcccccgtccgtaaataatcatggtgagagttacctgccagtgtattgtggaaagtggcttttgtgagttcgggctgctgccaatacccccctgccacagaatcacctcgaacccagacttccccaatactcgcctcaggcaagggctgacaggtctggggatcaacaatctgcaattgccatgctctaaccacgtgcccagagcttatcaaccgacgcccttgcggatctaaaatggctttacctgccgctaatgccattgggttaaatgccaaacagcagtaatcagtgtcgataggcttatggcttacggttagagtcgcttcggccagaccatagccaggcgtgaaactgtgggcatcaaaacctgtggatgcaaaatgggccgcgaaatttgccattgtctctgggcgaatgggttcagccccattcattgccatcttgatggaagagagatccaactggcgaatttgttcgtccgtcaccattgtggtacacaaatcccacgcaaaatctggtgcagccccggagttagcctgataatcattaatcattttcagccaacgaaatggctctgcaataaagtgcacagaaggcataaaattacagcaaccgcctgataacaatggcaataacaaaccgctgaacatgcctaaatcatgataaaaaggcagccagtttgcggtgatgattttcggctgacaatccagatgtgattcaagcaagatatgatgttgcacccgcatattatgatcgtaattacataccgcttttggctttgctgtggaaccagaagaatattgcagatacacaggtaaatgactggggtaataaagtgcatcataattttttttcgtaggaaaatagcgactgctatcggtgagttgttgatcaacaaaaataatctgatgtgtacgctgccaaccttgttttttaatttcgtcggatagcgaacttaatgtgaatatatattcacattggctatcagccaaaatatgagacaacgtgtcaatgctgcgacccaatttaaaatgattagtgagatgcacagggacagccgatacccccctaataatacaagcaataaagcttatgacaaaaggcgaacctcctggtataagcagaatagcaggccctggcggattgttttctatttcaatccgtgtagctaacgaatatcccagtgatatcagttggcgataagagtaagactctacatgatctttatcacaataacgtaatgcgatatcatgcttggaatttgttgcttgttcaaataacgcctccctcacccaacgagtttcattatttaataaattcataccattacctgcagttgcatatatatcacttttgataaatcgattactctatgcataaacataaagcacccacaggacatagctcttttacaccaaaattaatatatggctgtatctaatagtcacagccatatgtgtttttaatgtttattaaaatttaacattgaaattaaccccaaagttaataggttcacccgcgcgcccataccataccccatcatccattttgaaagcacgagtcacataagtttcatcaagaatattctttatccaaagattgacaccataatctttattttcataacccgcagtaagatttaatagcccataagctggctgttttttactatttgcattatcaagataggtacttcctttaacattataagtggcattaacaaaataaccgttaagaaagttataatcggcaccaatactataagtgtaccttggtgagttagccggtcgattatctttatagttaacagggatatagttattatctactttaatttctgttgggaagtttttaaaatatgcatcagtatagcctacatttgcgaatgcagtcaggccacgcgtaatgcgccactcaaattcagactccaacccacggcttaatgacttaccgctgttaaccgaataagaaataggataatacgccacttcgacttgctgatctttcatatcattccagaatagagacgtattccaacgaaccgttctatcaaaccattcggttttaacaccggcctcataagtcgtcatatattctgcattataagcgcgactagattgaggccctaacgtgttaaacccgccacttttatacccccgtgctatgctggtatatagcatggcgtcgccagtaatataataattcaatcccaccttaggcaaaaaagccccaaatgaattactattattatcatgagaatacggctgatatgggttaaacccattatccatcaaaaagttaagtttctttttctcatagtcataccttgcacccgccacaagctcaacatcattcagtaggtaataattaacattgccaaacactgcgtagttattggtcttgatatcggatttccgaatttgtgctaagttatagggcagatagcggaaatcaatttcattttcatcatcttgataaaaataatagctccctatcaaccaattaaatggcccactgtatttagagttcaaacgaaactcttgtgaaaattgttttgtttttcgattcatcaatagttcactaattgataatcgcgtaaaatcgaggtcttgattatcaacttttctttcgtctacataagcactaaccgaggtaaaatcaatatcatcaaaggtataaactgcatttacttgacctttataagcatcaacatcagatttgccaatataatttgagtcaacatatttttgacccgactttattttatctaatgcggtaaaagacgtgtttccgttacgcctattttggatatcaaaggtcgtcatcacatcccaaccatcatccataggttgccaacgtagtttaaaccgaccactaaaatcattgagattatctacattatttttaccgtcatagtcacgcttaaagtagccatttccataaagatatttcaatgctgcacgatatgaaaactgttcactgtcattaatacttccacctaaaaccgtggttacctgcgtgcgattataattcccataagatagacctattttatactcaggtgaaaattcaggatttttagtaatgacattgattactccagattccgtattacggccatatagcgtcgcttgagggcctcttaatacttcgattctatcaacatctaataattccgtatcaaaagtattagcataaacaccatcaataaagaaacctactgattgaatcccttccattccgggagtcgtccctcgcatggtaaaaaaacctgcgtcagatggattgcccgctttaaccatatagacattagggatgcgcattattgattcgtagatattttctatattttctctttctaaatcaaagcccgttaatacacttatacttatgggtgttttttgctgctgttgattaattttttgtgcaactaccgtaatagtgtctaattcatccttactgttattatgactttgtgaccacgctaggcagggtaatgaaattaaaaacgttacagttaaatatttccgataaaataccatcattaattttccataatgaagtgagataacaagattcaacaaccctgttaattagatgatatttactcacatttatataaattgataagaaggtgttatcaaaaatattattatgacactcactatattatttttattttatgctgttacctttcatttattatactagttgtaaacgattatcattttcaagtgggttggatcacattttatacaatcctattgccttacctgcattcagtaagaaggacatgggtaccgattcaaccggtcactcgccagtggcaggcgtacagcagaagtcacagtatttagggtactggcaagttaacacaccagtaccctgcatggagataaggcatttaatatcaatgcctttccagcttttacactttggccgcagacaaacagatcgtccgggttaattgatatgatttcacaaaggagctgatcggtaaaaattcgaaaggtgagtggaaattatgcgccccggtaaaataatttggagtcagcaacccttgggttgataatgccgcaccatcggtaccgccgcgcatagggatcactttaggttcgatattcagttccgccatagaagagaagatcaggtcgatagcccgcttatcttcaccaatcgagttactgatattgctgtacacatcggtcacggagtagctgatcttcgctcggggatattgtgctgaaactttcgcgaccacttcaccgatataggctttacgcgcggcgaatgacacattatcaaaatcacggattgctattttcagttttgcgctgttagggttggcagtcatatcggtaaaccagacatagccttcccgcccttcagtgtgttctggcgtctcttgtggcgagaactcactgataatgtcataggcgacacggatagggttgatcagcacatttttagctgacatcgggtgagccgtcaccccgatgatgtcgatctctgccgaggcggcgttaaagttttcatacaccacttcgcccagctcgcagcagtcaatagtgtaagcgaaatcaacatcaaaacgcgccagatccagcgctttggcaccgcgcagaccaatctcttcgtcaggaacaaacgccaccacgatatcgccatggcaatcgtcagccgtcaggttttccaacaacgtcatgactacggtcactgccgctttattatctgcgcctagtacactggtgccatcgctgaaaataatctcttcgccctgataacgcaggatttccggatgttctgcggtacgtagatagatgccctgctctgcgtttaggcaaagatcgctaccggtaaagcgtaagcgttgcggatgaatatcgggcgataagccaacgtcgaccgtatcaatatgtgtaataaaaccaatgcgtggtgcggtaggctgattgccgggtttacgggctgtcaccgtggcatgttcatcaatcaggatatcttccaaccccaattgacgcagttcttcagctaacatctgcgccattttgtgctgcccttcggtactcggcagtgttggtgaggcggcatcgctctggctgctaaccgccagataacggaaaaagcggtttgtcagttgttctgagagtgcgatagtcattttttattcctttatttatagctaaaaccactgagtgcgcgcagctaatgcccctacagcgtcaaggccgaagccccccaaagtcattggcgttgcagcaaggcagccagcaaacgacaaatcggtcgggaacgatttgaacagcatttatgctagcccgcagggtgagcctcacggatgaggctcattaatcccgatgagcttacttattttaaaatcaatgaccagtaagtgattcgggcgagcgcgcgccgctaacgcccctacagcgtcaaggccgaagggggtcattgagttgctggatacgtatacccactctggaaacctaatggaatatccagaccccagaacagatacaacatcagggtcagtaccacggttaaccctagtgtataaggcagcatcatggcgcataacgtcccgacgccggtcttcgaacaatactggcgacaatacataatgatcagcggatagaaggcaaacatcggtgtcgagatattcactgttgagctaacgcggaaactggcttgggtcaactctggcgaaatccctacggccatcagcattggaaccaatatcggtgccagaatggaccatttggatgacgctgacgtaataataatatccagcgcacaagataacaggatcacacctaaaatcgtgaaaccagcgggcatcgccagcgtacgcaggaagtccgcgccagaaatcgccattaatgtgccaatattagagtggctgaatgaatagaggaactgggcgcagaagaagctaaagaccaaaaacgagaccaatgagcgggtaatgttttccatgctggcggtaacatctttggtgctcttaaaggtgccagaactgaaaccatagatcaggccaggaatcgcaaacataaagaacagcagtggcacaatcgcttgcataatcggtgcatcagggcgggtcaggctaccctctggtgaacgcaataaggagttttccggatagagtgcggcggccaggccaatcaacatcagcagcataaccaaccctgcccgtttaaacgctttactctcctgcggagtgaccttctgtaactcattattgctctgcaacccactgagatcgctattcagtggcatcgatttaagcaaacgaggctccacaattttatcggtgataaaccagcacaccaaaatcacgccaaaggtgctaccgaaactgaggaagtagttacacaacacattgacgttatagcttgggtcaataatgtgcgcggccccttgggtgaagccctgcataatcgggtcgataatcgatggcgtatagctggcagagaatcccccggctaacccagcgaaagcggcggcaataccggctaatgggtgacgcccactggcatagaacatcatcgcggcgacaggcatcaggatcacataagccgaatcagaggcgacatggctaaccacaccgataaaaacgaccgctggcgttaaaatacgctgtggagtgacgttgagcatttttttcaacatcacctgaataaagccactgccctcggcaataccaatccccaaagtagcaacaatggtgatcgccagcggtgggaagttaataaagtttttgaccatagtggtaataaaggtcaccagttcaaccggtgccaatatattggtaactttaatctgatcaccggtcagagggtggaaataatcaaagttgataaacgataatccaaaggagagtgcccagcacacccccagcgcataaataaatagcatggtgatgtctggcatggcattaccgatacgctcaatcgcgttcagtataccggtctgccgatcgttctgcggttttacatctgacatattctgtcctttcccttgtaaaaatgtcatggctaaagcgagcaggagatactgatgatttcctgcctcagtagaggtactgcgtggatgtaagagaagatagaaccaatgaataatggaaaatcagctgataaatccgtcaatgaagagcaatatctcgcgaataacccatttatatccgtcgcccttcaagctgcagaggtgttggctgcccttgctcattccagtcactcagttatctaaactcttgggaacttgctcggttgccgcctacccgcatctcgacgtaacttgggtacagtaactcaatgaataatataatattttatcgataattttttataataaaaatcctaaaccgtcaatttaaattaattaaccttatcattatagaataatattaaatctgtcattttgagtaatagcattgattattgtcctagaaaattaatacatgcagatatagcaaccatttaatgattaaatatcgatatattagactaaaaaacaatttgatttattaaagctatctgggggccatcactgctaatcccttcacttcattgacctcgtcggcaacccacaatcccgttcagataaactgactcaggccgtcaatgagttaaaaataccagtagtagaccttatctaccccctgttatttatcagccaaaataacacctctaagactgattaagggagcgattttaatacaatgaatctatcaaatataacctcgaacgtgtcaatgccgaacataggaccagaccatgaaatccatgctgaccgggcagcagcaacagccttaactccggctgactatcatgcaatatgggaacagtgggaaagcgaggcgataccgggtgctaacgaacagcgggaccaggcagtagcaagaatgaaagagtgtctggaaaacaatgctgagcgcctcgaactcaataggcttggtttgacctcattacccgaaatatggcccacctcgctgtcctctttagatttaagcgacaatgtactcacacaattcccccaaaatttgcccgagggtttggattatttgaatgtttccagcaatcgtcggttacaagaatggccagattcgctcccttcatctctgaaagacctttgtatcacaagttgtggcttcactacgctgggaagtttaccgcctaatctgcaagatttgagagcgaatcataatcagataaacacgctacccgagacgtggcccgcctcgctgttacttttagatttatgccaaaacgcactcacacaattcccccaaaatttacccgaagggatggaggatttaactctttcatacaatcgtcagttacaacaaggcacaagctcactcccctcgtcgctaaaattcctcgatatcgtacgctgtggattcactgagctttctgaagccataaccagtttacctataacgtgtcaaattaatatgggacagcgggggagttcgggatatacccatcttattcctgaaaatgtacgtgagctactgctggatcgggagatggatcggcaggtatggatggagttggggccgtatatactgcgggcgcgggagcgggaggtactgctggcacaagaagcccagcaggaacgtccatcccctactattaacaatctcagtgacgtcattgccacctggctacccgcggagcaacaagacaaactggcaggaaattgggcaaccattgagcaggaagacaatgcccccgcatttagcgcttttttgaaccgtttggccgataccgtcagtgcgaaagaaaatccagagtttatactgcaagtcgccatctggctggctcaactggctggttcacctgcgctacgtgagcagacctttcttatcgctcaggaagcaagcgcgacctgtgaagaccgcattaccttgacgtataacgatatgcaaaaggcagtcatgctccatgaggtcgaaaagggacaatatgacacgcaattacctgaactgatggcgcgtggccgggagatgttccgtctggaacaacttgagaatattgcccgcgaaaaagtaaaaatactaaaaacactgaatgtacattcagtcgacgacatcgaagtctatcttgcctatcaggttaaactacgtgagtccttagaacttttctcagtaagcaaagaaatgcgcttctttggcgtatcgcatgtgacaacagacgatttactgagcgcagaagccagggtgaaaactgcggaaaaccacgatttcccgcgctggctatcacaatggtccccgtggaaaagcgtggtgcaacgtattgagcctgaacgttatgctgctgcgttcgaaaaacagtaccacgcactggagaatatttacccagataaactggcggctgaattggccgccaacgggatggcgggcgatgtggatgccaaccgcattgtcggcaaaagaatcaacgatgagataatggggaagatcgatatggccctgactcatgaggttctctctgccaaaggagccatctccttattagatagtcagtggatggaatatatctaatctcgccttaatactgcacggcccgctatgccataaaaaacggcgcatattctgtcctgcaatatgcgccgttgattggtcatttttctcccgccacaccacccgatcttttagccaattcaagccagtaagctgaaaataccagtagtagaccttatgcatcccctgttatttatcagccaaaataacgcctctaagacttattaagggagcggtttaatacaatgaatctatcaaatataacctcgcacatgtcaatgccgaacataggaccagaccatgaaatccatgctgaccgggcagcagcaacaaccttaacttcggctgactatcatgcaatatgggaaaagtgggcaagcgaggcaataccgggtgctaacgaacagcgggaccaggcagtagcaagaatgaaagagtgtttggaaaacaatgccgatagactcaatctacataaccttgatttgacgtcattgccagataccctaccaccttgtaacgaactggagatatcgaacaataacatcactgagttgcctactttgccaaacaacctgcaaaggttgatggcaatctgtaatcaactgcgtacattacccgatacattacctgaacatctattatctctatatgtggcctcgaataaactcgaacggctccccgagaacctgccagagagtctctatagattaaatgtttgcgataatccgtcactgcaattcccaaacaactggccttcgaatctgatgtatcttaacattgcagactgtgaattaactgaactgcctacactgccgaacaccttgacagaactgtctgcggattttaatcaactgcgtacattgcccgatacattgccgatatcgctgttaaggttaagtgtaaccagtaatcaactcacacaactccccgagacattgcccgcctctctgtcatttttaatggtattgggcaatagtctcaccgcactaccggaaaatttacctagtagcttaagctgtatcggcgctgaatataatcaattttcccaacttcccgatctagcacgtctgccccaaaactgcgaatttctcttggaaggtaaccctctttctgccagcacgctgttggcactacagcatctccgtactaacccgtattatcaggggccacagattatctgccgcgaattagacgatctcccccctgcgagtctcagtaatattgttgccatctggttggttcccgaacaacaaaacacgttggcaggagattgggcaaatatcgagacagaagctaactcagctgcttttagcgtttttcttcaccgtttggctaccactaaaaacacagaaaacatccctgaatttaaacaacaaattgcagcatggttgttgcaactggctggctcaccgactctacgtgagcagacctttcttatcgctcaggaagcaagcgcgacctgtgaagaccgcattaccttgacctataacgatatgcaaaaggcagtcatgctccatgaggtcgaaaagggacaatatgacacgcaattacctgaactgatggcgcgtggccgggagatgttccgtctggaacaacttgagaatattgcccgcgaaaaagtaaaaatactaaaaacactgaatgtacattctgtcgacgacatcgaagtctatcttgcctatcaggttaaactacgtgagtccttagaacttttctcagtaagcaaagaaatgcgcttctttggcgtatcgcatgtgacagaagacgatttactgagcgcagaaaagagggtgaaaaccacggaaaaccacgatttcccgcgctggctatcacaatggtccccatggaaaagcgtggtgcaacgtattgatcctgaaagttatgctgctgcggtcgaaaagcagtaccacgcactggagaatatttacccagataaactggcggctgaattggccgccaacgggatgacgggcgatgtggatgccaaccgcattgtcggcaaaagaatcaacgatgagctcatgggggagatcgatatagccctgactcatgaggttctctctgccaaaggagcctcctccttattagataaactgtggatggaatctctaatctcgccttaatactgcacggcccgttatgccataaaaaacggcgcatattctgtcctgcaatatgcgccgttgatcaccaccatgtcgttagtggctaattacctgacgataaaatcagaaattatatttaacgcctaacaccacgctggtttcgctgtagcccttgttacccacttgctggccgatatttccccaaagattcagctggttatttatctgcccatcaacgcccagtttcagctccgcaatattcgccgtcccggcttgtttcaccgtgacaccgtctaatgtcgtcccaaaatctttggtgttatggatccaattggcttcaacaaaaggcttgaatgccgggccgctgactttggctttatcacttggattgataaaggccttcgccccgagtcgcgtctggatattgccattgccgtcaccagagataaccgtaccattggtttctgtatggtcatcggcttttacgcccatccacaccacctgcgcttttggctgaataaaatagctctggctaacactttcgccaactttgaaggcatagcccccttccactgacgcggtaaagccttttgagtcatatttctcagcggctaaatcctgcccgctaacgttgttgtcaaaccaactgtattgcacccaagaatcgacatacgcgccagtatcatcggcgttatcggcaagccatgagccatagatccccacgctgtagccatccaccgagccagtagaacggtagccagcaacctgtgccacggtagaactgctgctattggcatagcccgccatcaccccaacacgccacaggtcctgtgcattgcggctccattgcgccacatcgccgccaagttgcatcacataacggttatcctgagttttcaactcgccgctatcatcgcgggagcgattatggctaccttcgttacgcagccacaggctggtggtcttctgttcaccggtaaagacatcggtatacagcgtctcacccattctatccgccagactggtgacgaacatattgttggccgccgccaggttagcggtgtaactcgccggttcagggcggcggtcatctgcctgagtacgcagataccagttgccgtcatctggagtgctggccccaccttgatacaagaagtactcataagcaccaccaacagcacgcccgttcagggtaaactgccctgcagaatcaccgccgacatcaataattttgatgccttcaaaggtgcgcgccccgacgcccccaatattgtttaccgtgacataactttgccctgcggtatccccggtaataaccagtctatccgttaccgatgtatctccggccaggatagtattgaaggtgatcatcccctcatcaccggtgtaattaccatcaatggtgaaggtgccaaaatccccgcccgttaaggcatttggcataatcaggttgccatggttctcaacattaccggtcacctgaccatatccccctaaggagccgttagcggtaatcagtacgttactggtcagatttgccatattcgatgcgaatgatacccgcaatgccctctcttgcagggactcttccagcgaaagtgtctgggtaaccgccgaactgcccaattgcagtaaaccctcttcaatcgtagtcagacctgcgctaaccgtatcgccttcaatttttaccgttccgctgccacgcttaaccaaggtccccgtgccgctgatggtattggttaactcccagactgaacccgtatccaggatcaacgcaccgctattggcgatgctgctgccacctaaatgctcggcactattggcaatgagaatactcccggcctgattagtaaacagacccgagtaaccgctgttatcaccggccaattgaacactggcattgttacttagcaatacctcgccatcactaccggtcaaagcgttaaacagtgtcccgatagtattatccagatgaagcgtgccgttgttattaatggtgccgttccctagcccctgcgcctgagacaggtgtgccaccgcgccattggcaatatcagtactgccagtaaagccagcgttatcataagaaacattcagcaagcctccactcagtaccagttcaccaccgccagtcaatgcaccatcaatttggccgccccccgttacggttaacttaccgtcgttgagatccagtgtactgcccccttcggtggctaactcacccaccacctgctgggtaccgttgatatcaacatgagtggcggtactcatcgccagcaaggaggtttgccccagtgctgaatcagcatccagacgcaaattacctgaagagacccaagtggtaccggtatagctgttggtgctattagataaggatgccgtgctgccatcattagccgacgcaaaggccagatcaccgctccctgtgatttgggctgaaagatcgttagattgagtcccgttattcgccaggatggcggtcaataccaacgcctcgctgcccgtgctcaatagttctaacgcggtcagaccgtaattgacatacaggccatcataatcctcgccagtggtcatgccgtaattaaacgaaccggtggcggcggctgaggtactgccagcgttatggaccccctgataagtgaccgcgctgattggatcaccattctcatccgtcaacgtcaactcatggcctgtccctgtcgccgccccagttgccagagtgacaatgatttcgccttcatccagttccatcaccgagagcccatccagacttggtgccagattgctcggtaaattaacccgaacctcaccgcccccggtggtattgatgctattagccgcaatcgtcccatctgaagtgataatgcctgcgttatcaacaatattatcaaacagcaacgtgccgccattcatcgccaatgtgccaatattctgcacaccgttacccaccgaggtcaggttaccgctggataatttcaacgtggcctgggccaatactgtggtgttattgccgcttaaatcaaaagtagaattgttcaggttgaccgtgccggtgaaggccccgcccacggtagcaccaaagtcaaacgcggtgctggcatcgtttttcgccacatttagcaagccgttaccggtcaacgtatgattaaacagagcaatatcgtccagatttagcgtcgcatcagcgatatcaatagttaccgcgttgcttaccccgttgctgctggtcagggtgacctcggcatcatcggtcacttgcagtacaccgctgccggtgacgctgttagcaaaggtgccgttaaagccgctcagcgacagggtatcgcccgcccctgccagcgccacgctggatgacgcccccagattgttcgttgacgcaaccgtcagtttgctgttacccgccaaggcatattggccgaggaagccgctgttattggccgtcagtgcggtatctgctccgccgataatatcgactgttgaacccgccacaccgctcagaacgttggcaatactctcgctaacgccattcaagatcagatgagaagtgagggtgcccagattaaccgtggcgctgctggcccccagattactggcctgacccacggtcagttcgccattggtaccaatctgatgtgcaccactaaaactgctattcccgctcagcgtcactgttgctgtggtattaatcgtcccgtcaccactgatcacgttagccagtgaattatccgcgaccaggtttagatcccccagcacatcaataacgctgctgcccaaattaccggttccgataatggtccccccattaccaagagtgactgatgcaccattggaaatattggtttgccccgccagaccgttgttgtcgatgctgatggtgaaatcgccacccttgatattcaggataccgttgcccgttaagccgccgctaatgctagaagcccccccattctccagattcaggatgccatcggtcacattaatcattccggtattgatcaaggtgtcagtactggttaactccccaccgttgcccaacgttaccgcaccgctattggtcaccgcccccaccgtctggcggtagccattaatattggcactggccccactggcgatattcagtaatgacgtctggccgaatgccccattcgccccgaggatcaattcccccgccgtgacggtggtcgttccctcgtaacggttattgccgttagccaaggttaaggcgccattttgggcatccaccacaaaaccgccgacaccggataactcggcattcagctctctgttggccgtcaaaccgctttcggtcgccagcaacaacgcattagcgccatcggctaacaactccagcgcactcagggtgtaattcacatacaggccactgccgccattgctggtcaggccatagttatgcgtagcattcgccaccgtatacccgccctgctggacagtagactgcaccccttgtcctgcggaaatagtggtgccattgatcatcagctccagatcattggcattgccggtcacattagcggcatcaatcagttgcagcagaatgtcaccccgatcctgctcaaggagcgacacgttcggtggcgtcaccggatgttcattctcccagttacccgccccggtaatactgatcgtcccgctgttcagtgccagatcagtaaccgtgacgaccccattggcctgagattgcggcggtgaaccgtcaaagatcagcgtaccgccatttaaatccagcccgtgcagggtgcggtcagtggtgccgacggtggtcacactgtcatccgacagttttaaggtggcacgcgccagtgccgccgcgttatccgcacttaaagcaaaggtggtattggtcagattgacgatcccactaaacgccccgcccaccgtcgaaccaaagtcaaacgcggtgctggcaaggttcttcgccacattcaatgtgccattcccggtcagcacatggtcgaacagtgcaatatcgttcaggttcagcgtcgcatcagcgatatcaatagttaccgcgttgcctaccccgttgctgctggtcagggtgacctcggcatcatcggtcacttgcagtacaccgctgccggtgacgctgttaccaaaggtgccgttaaaaccgctcagcgacagagtatcgcccgccccggccagcgccacgctggatgacgcccccagattgttcgttgacgcaaccgtcagtttgctgttacccgccaaggcatattggccgaggaagccgctgttattggccgtcagtgcggtatctgccccgccgataatatcgactgttgaacccgccacaccgctcagaacgttagcaatgctctcgctaacgccattcaagatcagatgagaagtgagggtgcccagattaaccgtggcgctgctggcccccagattactggcctgaccgaccgtcagtgcgccatcggtaccgatctgatgtgcgccgctaaagctgttattcccgctcagcgtaaccgccgcgttggtattaatcaccccgccgccactgagtacgttggtcatggctgcattggcaccgttcaggttcagcgtacccagcacctcgacggcgctggtacccaacgtacccgtcccggtcagggtcaccgaggccacatcggcaatatgggtctggccgctcaagccactgttggtggcactgaccgacaaattaccgccattaatattcagggttccggcaccggtcaagccgcctgccacggtagacgccccgcccgcagtcaggttgagagtgcctccggttaaatcaaggcccccgccattggtcagcaggccgctggttaacaccccgccgctgcccaacgttaccgtaccggtattggtcaccgcccccaccgtctggcggtagccattaatattcacactggccccactggcgatatccagtagtgacgtctggccgaaggccccattcgccccgaggatcaactcacccgccgtgacggtggtcgttccctcgtaacggttactgccgttagccaaggttaaggcgccattttgggcatccaccaccaaaccgccgacaccgaataactcggcattcagtactctgttggccgtcaaaccgctttcggtcgccaacaacaacgcattagcgccatcggctaacaactccagcgcactcagggtgtaattcacatacaggccgctgccaccattgccgttactgctggccaggccataattgtggatggcattggctaccgtggtgccgccctgctggatggcagactgcaccccttgtgaatcggcagtaatggcggtgccattaatcatcagacccagagcatcaacatctccggtcacattagtggcattaatcagttccagcgtcgtgccagcacgatcctgttcgaggatcgatacattcggtgacgtcaccggagattcattctcccagttacccaccccggtaatgctgaccgttccgctgttcagtgccagatcagtgaccgtgacgaccccattggcctgagactgcggcggtgaaccgtcaaagatcagcgtaccgccatttaaatccagcccgtgcagggtgcggtcagtggtgccgacggtggtcacactgtcatccgacagttttaaggtggcacgcgccagtgccgccgcgttatccgcacttaaagcaaaggtggtattggtcagattgacgatcccactaaacgccccgcccaccgtcgaaccaaagtcaaacgcggtgctggcaaggttcttcgccacattcaatgtgccattcccggtcagcacatggtcgaacagtgcaatatcgttcaggttcagcgtcgcatcagcgatatcgaccttcaccgtattgcctaccccgttgctgctggtcagggtgacctcggcatcatcggtcacttgcagtacaccgctgccggtgacgctgttaccaaaggtgccgttaaagccgctcagcgacagggtatcgcccgcccctgccagcgccacgctggatgacgcccccagattgttcgttgacgcaaccgtcagtttgctgttacccgccaaggcatattggccgaggaagccgctgttattggccgtcagtgcagtatctgccccgccgataatatcgactgttgaacccgccacaccgctcagaacgttggcaatactctcgctgacaccattcaagatcagatgagaagtgagggtgcccagattaaccgtagcgctgctggcccccagattactggcctgtcccacggtcagttcgccatcggtaccgatctgatgtgcgccgctaaagctgttattcccgctcagcgtgaccgccgcgttggtattaatcaccccgccgccactgagtacgttggtcatggccgcattggcaccgttcaggttcagtgtacccagcacctcgacggcgctggtacccagcgtgccggtatcggtcagtgtcaccgaggccacatcggcaatatgggtctgcccgctcaagccactgttggcggcactgaccgccaaattaccgccattaatattcagggttccggcaccggtcaagccgcctgccacggtagacgatccgcccgcagtcaggttcagtgcgccccccgttaaatcaaggatcccgccattggtcagcaagccactggttaacaccccgccgctgcccagtgtcaccgtccccacgttggtcaccgcccccaccgtctggctatagccattaatattggcactggccccactggcgatatccagtaatgacgtctggccgaaggccccattcgccccgaggatcaactcacccgccgtgacggtggtcgttccctcgtaacggttactgccgttagccaaggttaaggcaccattttgggcatccaccaccaaaccgccgacaccgaatagctcggcattcagtactctgttggccgtcaaaccgctttcggtcgccagcaacaacgcatcagcgccatcggctaacaactccagcgcactcagggtgtaattcacatacaggccgctgtcaccattgctgttactgctggccaggccataattgtggatggcattggctaccgtactaccgccctgctgaatggcagactgcaccccttgcgtaccagaagtaatggccgtgccattgaccagtaaatccaaggcatcaacatctccggtcacattagtggcattaatcagttccagcgtcgagccagcacgatcctgttcaaggatcgacacatttgttgccagcggatcggtgttatcccagctaccagagccggtgatattgaccgtcccgctgttcagtgccagatcagtgaccgtgacaaccccgctggtctgagactgcggcaccgcaccatcaaagatcagcgtaccgccactcaaatccagcccgtgcagggtgcggtcagtggtgcccacggtggtcacactgtcatccgacagctttaaggtggcactggccagtgccgccgcgttatccgcacttaaagcaaaagtagtctttgtcagattgacgatcccactaaacgccccgcccaccgtcgaaccaaagtcaaacgcggtggtggcaaggttcttcgccacattcagtgtgccgttcccggtcagcacatgattgaacagtgcaatgttgtccaggttcaacgtaccgtccaacccaatcttggccgaacctaattggttactgttactggcggttagcgccccgccctgattaacttgccacgtgccagcaaacatactggcctgctctaacgacacattggcgctgttattaacaatggcggagcccgtgccagtgcctaatgtcgcatgcaaaatcccatcaaacgtgctaccaaatagcagctcactactgctatcgatattgaccataccgctgccgatattatcgtcagacaccagagtgatatggctgtcgacaagattaatattggtgaagccctgaagtgacgtggctgccgctagttcgtcggttgaggcattgaaatttagggtattgagccccgtgcccgcatccagcgaaccgaggtaggtcctactccccacgctcatcccattgatcgtgaaagtatcattaccattcccagtgataatggaggacactgtcgccccattctgaatggtcacgctattattgccatcccccaggttaatcacatcgttactttgcgagctactgtctagcactaacgtgtcattaccggcaccggtggttaatgtgccatccagtgttccattgttattaatgatatggtcagcaacacccgcgaatatcacactgcctttaatggtgcccttgttatttaacgttttgctggaggagccgaggaagttaattgccgtcgcattctcggcattaagttggatttcgttgccaatggtggtggtattatctatcccatccgtgatttgcagcgcagtacccaatgtattggcaacattaatgatcaagttagaagcgttgagattgacaccaccgccagtggcttgaatgccgatcccggcaccattaacattaatatctaatgcctctgcatcgaaggtattcaattcggtatttgtcgccgcaattccgatgccggcaccttcaatattaatggtgttacgcccattaaggctatcgactaacgttaaccctgtcaggctatttagcgccgtcccattaagtgtgtttaaagttacgttacttaacgtcaaattgacgccagccacgtttgacaaagcaatacccgtacccaacagattaatcgtcaaatcagtcagggtatgtccaccctccgtgcccgcaaacgtaataccgttggccgtcgccgaggtattaatggtgccaccgaacagatttaatatggcactggccagtacgttaacgcctgtaccggcagtcgccgtgatggtaccgtcagtattatcaacgctgatctcttttattgatgcggaagaaatggcgatcccggcggtggtactggtgatggtgccatcattcttgattttaacggtgccggttccgttatgtgttgcagaaatacccgttgcagcagtgatatcacccgcagagcgaatataaatactactggcattattcgcattttttgtcgctaaaatcccagtattcgtggcctttaaaatagagccagtacccagattgtaaataacattagcatcaccactggcattattattgataccagcggcattagtggtggcgttatcaatcccattacctgaaataattgaaccatcggagcgagattgcagaactattttcaccccggaaccaaagccatcgatactattataactaccaatttccaagcctctattggtagtggttccgctgaaaacattctgattagcaattaactcaaagctagcaccatcagcaaaagtataggcaaaggcattaacaccggtactggtcaggtctccagtcgaccccgtccggtctatcttgacatcagcaccactggcaaaatccatggttgatgtattatttgccccgccagtgctgacaaaagatgtcacagaggaccccgtatgcgtaacatgaaatctaccggtaaacgccagtttattgacttcaccaatttcctgagcacggtcattgaccaccacatcgttcaagatatcgccaaaggtcattatactattggtggccgccccataggcccccatataaataagttgagaggaacccaggaaatcaatattgttataaatcacattgacggcagtattggcaccgttcaacacgaccatgctgtagtagttggccgagtcaattttggacatattttgtagcgttaaggtccctgaacccgatgacaccaccagaccataatttgtcgtattgttaacggttagaccaaactttccttggccatcaatcacaacctgattactcgtcatattgacggtcaggctcccaatgagcgtaatgtcagcacctaaaataattttgtcataagtaccattggataacgcggcagaaagctctgcctgcgtgctgacagtaatatcagcagcaaatacagggccggtgcttagaaaaacaatactgcccagagatagggccaaaaggttttttctgaacagtttcgataccatactttgttcaaattttggtaatacaccctctgatatcaagttacgactgctcttggtttttatccggccttttgccagctcactcaccacaacccagacattcaaagatgcattccaaatcactttaaatattgtattcatatatagccttaacaaatttttaatttgtcaattaagttgataatgatcgcatcacataagtcagatgacagacatgtgtcattggccaactcagtaatgaataagcgattaagattttaaaaaaagtgattcatatgcagtaaggccctgaaaaatagcccattacttagatatatgctgttaaagaaattgttatgcgcctaaaaaatcgcaaaataggaaaaactgcacaatttaacttaccataccaacttatacgttcttttaaatttcatcacaagaacgatgcaacaaaacaatgtagatcaacatctaatcagaccggcgtataaaagccatgaatagcaccgtattcgatataaaaaaccacaataaataaaatataaggattaaaaatcacaattcactgaatatgcaattttaaatattaagacgtataatataaaaaaggaaaaatcccacaaaaatacaagaaatagactacagataatgtgcaaatatcttatttatatggagtgtgggattggctgtaatcatgcagaattcaatgaaaattgaagcatcttgcttataaaaagaaaagtagacaccacaataatttattaaattcatcaaaaacaacaagatgattcagtaatgtagttactgtttattttatttgttatccaaccgatgagacatgcgatcacactcaccacttgttgtgaagaccatcactctggtgctggctatttttgacctgattcgctatcgatctcataggttatcgatctcatgggctatcgatctcatgggttattggcctgattagttattatctcaggccactctcggcgcttatttttgcagttgcaacgtcgtcaaacatgtttgactctcggcaccggtcgcaaaaggcgagaccgcagtgaggccttgatagctaacttcaagggtgccttcaatattgcgtggcagccagacgccaataaagccattttgataactggttacctgctggtgcataataaccttgcctgaattatcggtaatcttcacctcaaaaggcgtattggccagttcgccacggcaaccagataaactgtggttaaagcaaggatgtgtttggttaatataaggggcgaatgacaaataaaatctatcgcccagcggataaacaaatttctgttgcccatcagatagtatcagttcggtatgggttaccgatgccgaataaggcaacgggcgcgtttgtggcgactgatcgatagcatcgaccatttgttcggcactcttgcccgctaaaccctgctgagccaaaaaatcagtttgttgtgcggtcactgaggaagagggcgaagattgtgcagaggccatatggctataggtgatggccgctaacgccatcattgtcagccgggcagttaccacgaatgtttttttcactgtcgttttatcctttttatcaatgtgttaattgcctacaaactaaaccctccccctgggggaaggtcaaaggcagaattgaatagaaaggtaaattttttaattaaagtagaagacaatataaacatgaccgtgaaatctctaaacgggatgagagagaagagataactcagccaatcattaatatacagattttaccttattttatatttagataacttcctggaaaatatcaattatatatttttcgattccgtcaaaaaacaggatgaaatatggatattttttcaagttttaacttatacaataaagaagtgtatagtaacagtcccacacaccctacctttgacaaaagcaagccgtatatatcagaattaaaaagtcgtgaagagaaaaatctaaacggtgaagtcaactttaaagacaatgttgacaaactgattatgtgccgtcatctatcaagtcaatatatattggattcattatccgatgaggataccggaaaggttgatttagataaattctcatccaaagacatcatcgcaaaccgaataactagcaacgttgaagagctttacgagcaacttcagttgcaagcaaaagaaatttattttattcctaacaatgaatttggcatctgtctcagtaagatctttaagagtatggagagaaagtcagaaaatactcaatccatactacttgagtcattcaaccacgcgatggcagtaagattgagaatcaaggaaaatgaaaacaacaacacgaaaaggtacgtcattagtgtttatgaccccaacatgactaatgttactgtccgctgtgaggtggatgatttagttaaagtgagagattttcaggtgaaggattttattaatcatcatttatttggcaacttttacaagagctactacccaactgaatcaagtgaaatatcaaccctttatatttgtaaaaaaccagctaacgaaagtgttcctgagtgtacagggaaaaaaattacattttatgattggatagccttacctgcctcgtctattaatttatacactttcctcattgagggattctcacaagaaattaaaaatctaaaaaatcaattagaaataatatataagaaaaacccggaaaagctgatggaaatacttaccgctaaaagtcccgatggaataatgggttttgaacaagcattacttaatgatcacgctgatgccataaacgcatttggcgagctgctacaattagttcccgaaaacaaacgcagtgaattacttgtaaataataaaaaaacaaagtacacattatttgatatagtttgttctagagaaaaaaataaaacaacaatggcattcaaaaatatagtgtcacttatctctaaaaatgagcgttataaattaatagaatcaaaagtaaacatacttgatactgttattaattcacttattaccaaaaaagacagtagtcatcttaacgaaatttttgaattaatctcattagcgccagaagagcatgtcatcaacttactgtccaatatagatataacgcaatctcttgaatattcgttatatcacaatgatactaaatcgataaatatcatcactaaaatgctcaagggattatctgaacaaggtcgggaaaatataccttttctgagaaaattagatgagtctatagtgaatatgtatatccaactcggtaaaaaaatagccgtttctgcctaccgtgaattattggcactgaaaccgggaacgctcaaagagagtaaatagccattcagtcactgcccccaaagagtcacccatacccaccggtcttaaccggcgggtatgggctttatgacaaaacagcattaaatccaaaggattggatagatcgcatcaccttcttttacaggctttcgtcaacatcctgcttgcggttttttgtccactcgcgcaaccgttgaatatgcagatacagcgccggaataaataagatccctacggcggtagccatcaacatgccgccaaataccgtgataccaataatctggcggctcatcgccccggcaccgctggcaaaaaccaacggcatcacgccgaggataaacgaaatagcggtcatcatcacggcgcggaaacgctgtttagcgccgtcctgtgcagcctccgcaatactcgccccctcttctcgccgcgccttggagaattcgacaatcagaatcgcattctttgccgccaacccgatcagtagcactaagcctatttgcgcatacacatcgttggcaaaccccatcgccgatagccccgccaccgccccccccacggcaaacaccaccgagagaaccaccaccagcgggatactccagctttcatactgggcgactaaaaacagataagcgaagaccagcgccgcaagataaataaacaccacttgcccgccggtctgctgctcttgccatgacatcccgctccaactgtagctgtagccttgcggtaaattctgcgccaatagcgcttccattgccgccatcgcctgacctgagctggccccatcagctgctgaaccgctgatcgcaaccgaagggaactggttgaaattactgataaagggcgcgcccactgacggggtcaacgtgaccaggttcgccaaactgactaatgccccgttatcgctgcgtacattcaggttattgatctgcgccgtgcgctggcggaaattcatatcgttttgtaattgcacccggaacatacggttattcaaggtgaaatcaccggcattcatcccccccagcgaggtttgcagcgtttggaagattcggctgaccggcacttgtaacaaggccgcgcggtcacgatcaatactcaaattggtttcaggcatcgaagcactgaaggtggtaaagacccggctcaatgtcgggtcctgattggcggcaaaaataatcccttggctcacctgcgccagctcttgcggcgattggcctagcagtgcctgaatgcgcaaatcaaagcccgaagcactgcccaaaccagcaatcgctggcgggttcaccgccataatcatcgccgaggggatagccgccagattggcctgaatactggccagcacccgatcaatatgcggccgctggccccaaggttttagcatcacaatggcaaaaccggcattgggcgcattgttgccactgagcaggctgaaccccgtgatttttattacatcttcaacggcctcattcgtgctcacctgttgatacatctggtccatcaccgtttgggttcggttcagtgaggcaccatctggcaattgtaagctgacaaagaaatagccctgatcttcctctggcaggaacgaggttggcagtcggctataaccccaccatgttgctaaccccaccagtagcagcgcggcgatactaaataccgcacggcggttgatccgccccgttaagccaacataaccatcacgggcgcgatcaagccccttgttaatcgtgccgaacatgcccgtcgttgcgagtgtgcgccgcttaagcaggacggcacacagcgccggactcagcgttaatgcattgatactggagagaatgaccgccgccgaaagcgttaccgcaaactggcgatacaactcgccaataatccccggcaagatagcgattggcacaaataccgccatcagcaccagtgtggtggcgatgatcggcccggcaatctggctcatcgcctgccgggtagcctctgccggtgaaagatgagggtcgttcgacaataaccgctcaacgttttcgaccaccacaatggcatcatccaccacaatggtcagggccagaataatagcgaacagactgagagtattggctgaataaccaaagacatacagcacagcaaaggtgccaagtaacgagaccggaaccgtgagcgccacaataaaggtcgcgcgcagactttgtaaaaaaaggtacaccacggcgagcaccacaatcagtgtcaaggtcagtgacaccgcaatctcatgcagtgtcgccgtcaccggcagggtggagtcgtaattaatttcataggtgagatccgccggaaaggcggccgacagccgggccatttcatcacggacgccattggccacattaagtgcattggctccgggaaccggatacaccactaagaaggctgattcagtctggttttgtgccgcactgacctgataattctgtgcccccaaggccacgcgggccacatcgcccaagcggatcataccgccctgagggttgctgcggataatcacatcggcaaactgccgtgcatcggtcaagcgcccctgcccactgatggtcagtgtctgttgttgattgggcatcgacggtgaagagcctatctgccctgccgccgcttgtacgttctgctgttgtagcgcggcaacgatatcctgcacgctgacattcagcgattccatgcgctgtggatccagccagacacgcatactgtaatcgcgcgcaccaaagacctgtacatcaccgacaccactgatacgtgcaatagcatcacgcaattgtatgctggtgtagttactgacaaacagtgcgtcatgggtctgttgcggggagaaaacgctgacccctaatagtaggtttgacgcacgtttgcgtaccgagatgccattttcattcacctccgcaggcagttgcgcgctcacctgcgaaatgcggttttgtacctcaaccgccgccatatcgggatcggtgccactggcaaaggtaatgctcaattggtagctgccgttattggcgctggttgattccatgtacaacatatggctgacgccattgacctgcgcttccagtggtgacgcgacggcttgcgccacgtctctggcgctggcaccgggataaacagcactgacggagaccaccggcggcgtgatatccgggtattgctcgaccgggataacatacagtgaaacccagccaaccagggtgatcaccaatgcgataacaatggcaaacttggggcgacgaataaagaaatgcaacatctggtcttccccttaattagccgtcaatggcgctgcaacgcgatcattcacagttccatcatttacagttccatcattaaccgtgctggcgttcaccgccatacccggtcggacatgctgtagccccgctacaatgactttttcacccaccttcaccccatctgtcaccgcatattgctgttcgaactgttcacccagggtcactgggcgcacttcgaccaccgctttatcggtcactaccagcacaaaatggccctgtttattctgttgtaaagcagcaatcgggatgaccgtcacaggtttggcgtcgtctgcagccaatgacacattgactacgccaccgggcagcaacaaatggcgagggttggcaaaacgagtacggataatgaccgttcccgtctgcttatcaatttggttatccaccgattcaaaaacaccactctctggatattgcttaccatttgccagttgaatgcgaggggtaaaagtccccagaaggagcaaggggttttcaatatttttttcacgggcgacagcgcgttgataggtcgcggtaatgtaatcccgttcattgacggcaatcgccacccgaatcggatcgagttgcacaatattgaccaaagtgccgctagcgggattaatcaggctgcccacattaaaacggctgtgacccatttgcccactgattggcgcatgaatttgggtgaagctgagctgtaactgctgaatctgtaggttagcctgcgcctgcgccaccgctgcccggctgatatctcgctgtgcctgtgcttcatccacctccgcctggctgacagaacggttattacccaagcgttgtaaacgcgtgaggttcacctgtgcatgattggcgctggcagtcgcgctgtcgagttgcgcctgtgcttgcgccaccgatgcttgatgcaaagcgggatcaatttcatataacagttccccctgcttgaccattttcccttcagtaaacagacggcgggcgataaatccttcggtgcgggtagtcacatcaaccgcttgaatcgcctcaatccgcccaagatattgcacggcattgtctggtgttattgacgcgactaccgcgacggttacggcaggtaaaggcgcggtggccgcactcacagagcccgccccgagtatgagcagaaaaagcgcatgggacagtaaagaatggcggtgttgctttgcccgcaaaggccccattcgcggagagcgtaagattagtggagagcgtaagattagccgagagcgtagggttcgcggcacgtaaaaaattggcgtggaccgaacccaattcagtgtaaacatggtgatttattccttactctcggcgggatagaacggcttggtgttaaacctgatcttattaaataagatcacatgaaacgaagatcccatgaaacaagatccacattagaccaagcttctcggggtcagtcatattctgtcgcaactctaacgccttactacagaaattcccataccttaaataatttgatcagagggaagcgcacagtttgatactgatatctccgtcatacttcaagttacctgtacgttggccacctccctgcaactcgacttatttcgggtagaagagagaatttatcaatagagtcaattatcacacgttaaaactataagtattcaaaggttgtgctagtttatattgcctgctgatttaacgaattacttttctaccattaaatttcagtccgcatatgtaatcgctaagggaacgcgctatgaccaatgccagaccgccagaatcaacgtcacggataacaggggaaaatgttttttttgcaaaacggatactgcaaaccatggctttgctggttgggatgacgatcattattgctgctgtgggtattatttatatcgcatcacaattaaatgaacaggcaagtgtacaaagccgcttcctgatcgaaaaagcgtggaaaatgcagcaggactcactcaaaaccagaataaaagataatgcattttggggtgatgcttaccagcacctgcatgtaaaaatggataccgactgggcctttattagccaaaatatggggccttccctgtataaagattttagtcttgaaggtgtctttgtcattgatgggcagggaaagacccgttattcagtgatcaatgggcaattagtcaataccgacctacagagttggctgcataaagatattacgccactaatcgatatcgcacgtcagcgggctgaaaaaccatatattgctgtcgatactctcgaaatagcgggtcagccagcattaattgccgccgccgcattaacccccggagaggatccgcgtgtccaatgggttgcgggccccccttccgtgttggtatttatcaatatcctgacaccggctgaactgagcgcattgggggagaattatggtatccacaacctgcgtatgccgagaaatagccaggatgccacatccaaaccttcgctggtcatcgcctcatcagataacagtaccctgaccttacattgggatcaggagatgccaggaaccccattattaaatatcttgctaccgttactggcgttggttgccctaattattgggttaaccgcctggctggttatacgccgcgccatctcggaggcgcaagccaccgataggagccgggccgcgttggctgccagcgaagaacgtttccgccatgtggcagaatcggccagtgattggttatgggagaccgacgcagagttgcaggtgacttatctctcaccacgcttcttaatcatcagcggatggagtgttgatcactggctggggcttaatcttgattcactgttaaattgtgacattacttcgctacggacttggttgcagcacacccatttaactgattcacgtaacgaactgcaatgcacttatttctcagctaaaggtagcaaacgggtctgccgaatccatgccaagccgatcattcagcagggtgaaatcgtcggttttcgtggtaccgcctcagatcttacgcgtgaaatcgaagctgagaaacgtattgagcacctttccctacatgatgcgctaaccggtttacctaaccggacgttgatgaccgagttcttggaaaataagctgcacaatctggccgccgtagagcatcccttggtgatccttaatgttaatttggataagttcaagcccgtcaatgacatctttggtcatgtcactggcgatcaagtgctttatcaggttgctgagcgcctgcgctcctgcttgcgtgacaaggatttagtctcccgccaaggcggagatgagtttgttttgattatttccaatctctcctcttcctacgagatcgaactgttatgcgccagggtgatcacccgtctccaaacaccgtacgtgatcaatgatcaagagatttatcttggggccagtattggtattacgttagcaccacaagactcaatgcaagcggaagaattgctgcgattcgccgatatcgcgatgtgtgaagccaaaaatagtccccgtaaccggtggcgtttttacgccagtgaaatgaatgaccgcctgatgcaacgaattgaacttgaaaagtttttacgtttagccgttaaaaaaagcgaattctgtctttactatcaacctcgctaccgtactgacgacatgcaactgataggggcagaggcgttggtacgctggaatcacccggttctggggttgctaatgccagatcaatttattgcgttagcggaggagaccgggcttatcactgccatcagcgattggaccctcttacaagcctgccaagacgcgatgacctggccaacctcattgattgtctcggtcaatatctcggcgattgaattcaggggccaatgtcttatcgagcgagtccggcaagccctcttagtgacaggtttgcccagccatcggctcgagttggagatcaccgagaggatcatgattgaagatgctgatggcgcactgaagatcatgactgcgctaaaaaccttgggtatacgcctgtcgatagatgattttggtacaggatattcttcactgaattatctgcaccgttttccttttgacgggttgaaaattgataaaagttttattgataaactcaccgagtcacatgaaggacaatccattgtcgaaggtattattaacctgggccatgctatttcaatgaccgtgatcgccgaaggcgtggaaacggccgagcaactcacctatttgcagtcactccattgtgatgaggtgcagggatattttcttgccaaacctatgccggtagaggcgttgtctttggttttttctgaggatttatcggtgtgatggtgggggcgggggtggtgctcaggggtggtgctcggttcgtgctcggttcgtgctcggttcggttgacaggagatcggcgtttacccagtctccgatgccgcaaccgccaaaggggtcacaagcgtgcactgaaccccagatcttggatctttttatccatgatctggaggttcggttcaatgaaacaccctttttcaacccgcctagcggcggttcaacattacctttcaggaaaggccactctgcgggaaaccgcacgtcaattcagtgttggcaaatcccctcttacgcgttggatccgagcttttcgccgtcaaggtgaggctggactggagcaccatctttccagaacttatactccagaattcaggctttgcgttgtccgctatatgatggcaaacagatgtagcgctgccgatgcttctgctcattttaacattcccaacgagacgattatccaaaactggatgaaacgttatcgagagggaggaaaagaagcgcttaacccatcgaaaacgggtcctactatgccaaaagataaatatgagcacgattcaaaaccgttcagcgagatgacgcatgcggagctagagaaagaacttgagtatctgcgcgcggaaaacgcttatctaaaaaagcggaaagccctgagagaagaaaaggcactcagggagcagcagaaaaaaccagaatagttcaagcactgacagcagaacatcgactttcttgcctactgtgtgccgcaaaattggcacgcagtacatactattatcatgcatcgaaaccggacggtgtaattgatgactatgcagatgcggtaaaagcgattggcgccctaagcagacgacacgcacagcgctacggttatcgccggatgacggtcgcactgagaaaagaagggttcacactgaatcacaaaacggtgcgaaaactgatgaatcagcacgggttactcagcctcattcggcggaaaaaatatcgctcctatagggccgatggtggccgggcatccgataatctattggctcgtaattttacatccgaaatcagtggattgaagtggtgtacagatgtcacagagttccgagttggagcacagaagctgtatttgtcggtgatacaagacctgtttaataatgagattatttcttggcatatgtcagaaagagcagcattaatcctgacgtgcaagacgctggaaaaagcgctgaaagtgaaagggagaaaagaaggcctgatgttgcacagcgatcagggctggcattaccgaacgccgatgtggcgctcaatgcttgtcgaggcggggataaggcaaagtatgtcacgcaaaggcaattgtttagataatgcagtgatggaaaatttcttcagtcacctgaaagccgagatgtatcaccgtaagaagtacgattcagccacagttttaaagcgtgacattgtagaatatatccattattacaatacagagcgcattagcctgaaaacaggcggaatgagtccggcagaataccggactcaggtagaaaagcagtaaagcagatgtccaagttttggggttcagtgcagcgcgtgaccccttgtggaatccccgcgcttgcgcacgtatcgcttgtccactgcgtggatgccctccgtcatcgtttcggctggcggacggctttacgcgggtccctccgcgtgacgcctaaaacgggcgtcctgcccgttttccttgccttctctcttcattcggcagctcaaatgtgcttctaaggtcaaaacctaaaagatactgataaaagtaaaagtaaaagtaaaagtaaaggtaaaggtaaaggtaaaggtaaaggtaaaggtaaaggtaaaggtaaaggtaaaggtaaaggtaaaggtaaaggtaaaggtaaaggtaaaggtaaaaggtaaaggtaaaggtaaaggtaaaggtaaaggtaaaaggtaaaaggtaaaaggtaaaaggtatagaaaaatacaattcgttaataaattgtgttaaaaaatgacttatatccaaaataatgtgagtttcgggaaggcggtgactgaattgaacgaaatcagcctacgcatatgcagcttgaaaaatgacgggtatttatatcaacccaggtgttaaacaatgaaaaaaacaatagtgagactgtaaacaatattgtgtaattgcctgtttttgatatcttcactccaacaacggagacaggcaaattatggacgaaaagaaacttaaagcacttgcggctgaactggctaaaggtcttaaaaccgaagccgaccttaatgcattttctcgtatgctgacaaagcttaccgtcgaaacagcgttaaatgcagagcttaccgaacacctcgggcacgagaaaaatacccctaaatcaggctcgaatacccgcaacggctattcgtccaaaacactgctatgcgacgacggcgaaatcgagctgaatacgccacgcgaccgcgaaaacacctttgaaccgcagctgataaagaaaaatcagacgcgtatcacacagatggacagccagattttgtccctgtacgccaaaggcatgaccacccgcgaaatcgtcgccaccttcaaagagatgtatgacgccgatgtgtctcccacgctgatatctaaagtcaccgatgccgtaaaagagcaggttgctgaatggcaaaaccgccaactggatgctctgtatcccattgtttatatggactgcattgtcgtaaaagtccgccagaacggtagcgtgataaacaaagcagtgttcctagcgctgggcatcaacactgaaggtcagaaagagctgctgggcatgtggctggcagaaaatgaaggtgcgaagttctggctaagtgtgctgacagagctgaaaaatcgcggtcttcaggacattctgattgcctgcgtggatggcctgaaggggttcccggatgcgataaacagtgtttatccgcagactcacatccagctgtgcatcatccatatggtacgcaacagcctgaaatatgtgtcatggaaggactataaagccgtcaccagcggtttgaaaatggtgtatcaggctccgacagaagaggcggcgctgatggcgctggataagtttgcggaggcctgggacgacaaatacccgcaaattagcaaaagttggcgtacgcactgggaaaatctcaatacattcttcggctatccgcccgatatccgcaaggctatctacaccacgaatgccatcgaatcggtgaacagcgtgatccgtgcagccattaaaaagcgcaaagtgttcccgacagacgactcagtgcggaaggttgtttatttggcgatcaaggatgcatcaaaaaaatggagtatgccgatccagaactggcggttagcgatgagccgttttattatcgagttcggtgaccgcctgagcgatcacctttaatacggtggcagttacacagaattatggacaggctcacaatagtacattgttattatattttttgtttttttgctctataccttatttcctcatttaaagaggaggcatttatcgatggtatagaaataaagaatgcatgtgttgcacatagagcctttgttgttgatgacatcagagactttacagtgatatttgccataataattcttatcccctgctttgtttatttgaaaaaaaacagatttaaaaatcaatttttgaatctgttaagtatattactaatcatatatttcatttggcgattttttatacgattgagtttctgttaaaaaagtggatcggtcatgatgttgtctggcgggcggctttgcgcgggtcactccgcgtagcgcctaaaacgggggtttggaatttgcttttggccctgggcgttcatctctttatctttcacagagaccttatcgcattataaataatataaattttgtatatgaatcaatctatctataaatcaaccgtgttatgctcatctgaccgggcgatattcaatcggttctgggctaaaaggggctacaccatggttaaaccatttattcttgctgctatcgccgtcgccacgctaagtggttgtgccaataacaataccctttcgggcgataccttcagcagctctcaagctgggcaaacccaatccgttacacacggtaccttagtgtctgtccgccctgtgacgattcaggggggggatgggaataatgttgccggagccgtagggggtgccgttgtcggtggtttcttagggaatacgatagggggtggcaccgggcgtcgccttggcaccgcagcaggcgtggtggcgggtggggtcgttggtcagcaggtccagagcctgatgaatcgcagtagcggcgttgagctagaagtgcgccgtgatgatgggtcaacattcctggtcgttcaagctcaaggtgtgacacagttccacccagggcagcgggtgacgattgccaccagtggcagtaccgtgacgatcacgccacgttaaaccttcgcatcacccttggtatctgtttcttcgctgccaagggtggtttcatctttgacggttaatggaaatttaacggccaacacgcggatgacggatgacggatgacggatgacggatgacggatagaaaaattatcgggtcatggccattcacacttcgggttcaccatatttattcttaacgggttctgattttagaaagagacaaataggcaagataagaaagggaacaaacagccatacgaaggctgagtatccggcatcatgaagtctgcggatactgcttgagaacaacggaagcaataaaataataaaaactgaaaaggcaatttcgctactatcaccttcgttactatcaccttcgttcgtgccaccgataaaaaagtagtcgtagcagagaaatagcattgtctgaaataagacaatgctcacatattgtaatctattgtctcttcccgtcggatcaaaagattttttgtaccctcggataatgagagcggttattttattgattattttcatttgattttttctttctcagaaaaaataaaataataaaacttattactgttgatataatgtagtaaggatagaaatttatataatcaacagtaacgctaaccaccgcttcatttaacctaacatcgtcacggctgctcagatacagaataaccaatagcaaaacagcattcgtcaatagaaatttgacgtgaaaaatcatctctttctttaacgagtcgtatttatccaccagggtgaataaataatatatcacgcaaataccaacagcaaacatggcgacatcaattaagggcttgcggatgaaagcctccgcatcatcaaccatcaagtgcttgccatgaaaataaacctcaaccaaggcgttcggcaccacgaaccctatcgccgcatacacgatgataaggagaggtagcccccattttggcgtggtaagcatcatgttctcgcgccgctgttcttgatgtcctgcattgatttagagagctcatgcatcgatttaatcaatgatatttctccggtgtttttattatattttgccgcagccgttggcgcatttcggccaccgttatccataaagaaagacacattacttctgccatgcagagtgatattttttatcgtgtctgaaccatagtgtaaaagtttaggcgtcgagattttatattctttggtgaattttttgtagaagtaattagtattaccttcaagtctaagaccttgaataggaacagcagcaaactcactcccggcataatccaaaacataagcgaacttaacctcttggctatctttagtggtaattttaccgccggtaatagacttaagacgctgccataaagtgatattactgagatcgactttctcgccatccaaaaaaacgtcttgttttttagtgagttggtatatcatccggtgtacttgtaccaaagaaggcccgacagtccctacagacggcgctaaactgtctcgaggataaagccgctcaacaataaaaaatatattcgtttttttatgattttcaattccgttcataagctaaacctttattcctttaaataaaaatcagatttgattcagcttaccatcatccctacggtccgtacatccttgcttgatttgtggtttcttacaattatgtatgaaatatcctgtaggccagattattacgcagattaatgccccaatatttatccattaatataaatatttttatctatgctcaataattcgaatttcagtaaggcagccagcgaaagagaaaatcggtcagaaaccgatttaaaattgacacgattctatttagctgaaaaatattggtgaaaagagctaaaaactgcccccctaaaaagcaccgtccagcccgtaagagtgagggtgtgtagactggacggtgaaacaccaacatatgctcgtcatacttcaagctgcatgtgcgttagccgccctcctgcaactcgaaatatttagggataaaacaacgcggtcatacggctatttttcagctttctcagccgcaggtttcacgacattctcaccgtgatgaccaaagaattgatacaaggtatcggaagctgttttagttaataccataatttcaatacggcggtttttggccgccagcgggtccgttgggtcgagtaacatttggtctgccatcgtattgatttgcaagactcgcccttcatccaatcccccattgaccaacgctttatgcgccatcagcgcccgttcaccagacagattccagttgttgtacaacaactgatcacggtaacgagaagcatcggtatggcctgtgataataattttattatccatctcgttaaaagcaggagctaattcccccaataaccgactaaagaaaggtgttaacaccgcactactgcgctggaacatatcccgctgctgatcatcctgaatcagaatacgcagcccttgcggcaccacttccatttgcagattcgattgcgcattgtaggccgaggtgatctgcataataatccgcgatagctcttccatctcatgacgcgatttatccacaacctcctctaatgatttttctggttcaggaacctcaattgcgaggttacttttggtctctttagcctgctcattgccatcaatgctattcgataatttgccaccgccgcttttactttttgacgggatcgaaataaaagattgttgagcaaaaatggtttttccattcaattgcgccacaatttcttgtcgctcttcttccgataccacgccaacaatccacagcaccataaataacgccatcattgccagcgtaaagtcggcaaacgccactttccaagcgccggagtggcggacatggtgcttttttctgtttgcccgcttgataatggtcgtggccccgccactggcatgatttctcattagacgcctgccgttatcagcttattgatccaagagtccaacgtggcaaatgtgggtttgttgtccatcggtagcatcttgcgacctgcatccacagccagtaacgacggcttgcccgcgacatgattaaccaacaccatgcgcacacattcaaatagtgccagtttctttttgatctcttgttccatcgcattggacaacggatccatcaggcaataacaaataaacaccccgaggaacgtacctaccaaggcggcagcaacttttatgccgatcatggcaattgagccatcgatggattgcatggtaatgatgatacccaacacggcggcgcagataccaaaccccggcatggcttcgccaatacgctggaaggagcgagagggcaccaatagctcctcttcaacagcggataactcctgttctaaaatgctttccagctcatgttgattaattttccccatcgccatcaggcggaaattatcagagataaaggtgatcaagtgcaggtcctgtaaaataagcgggtaacgctgaaataccgaactgttggcggggatttcaatatgctcatccaggcgtttcaaaccaccttcatcaaccatttccagcaattcatacaacaacaacaataattgctgttgaaactcaaccgtatattcactccgacgtgcaacggctaaaatttgatgccacatttcctgcaatacggaaccgggattacctaatatcatcgccccgatacctgagccaaaaataatgataatttcaccgggttgccaaaatgacgatagcgaaccgccagacattaaatagccaccaatcacacaccccataatgaccagtaggccaaacagcttctgcataacaccctcgataatttaaaaaaatgatttaattttttgtactaatttcttattgagttggcagatgcgtgcctcagtgagatccagtacttgtgcaatctctttcatactcagttcttgctgataataaagatgcaaaatcatctgctcacgttcatctaatgcgctgatcgcctgtttgagattatcttcaataataatattctcttccagatcacgactttgcaaaatatcattgtgagcatctaatgcgagaatttcatccaggctttccatcgcacccgcattctccaacaagagatattcctgatattcatctgccgttagatttaattcggcgctgatctcctcaaagttaggttcatggcccagccgtttcgcgatttgccggattgcctcattggttttgtgggttttctgccgcaaccgacggggccgccaatcatgctccctcaattgatccaatattgaaccgcggatccgatgaacggcataagcggcaaattgcccgtcagggtgaccatagcggcgcagtgcctctaatagccccatcaatgcaatttgctgcatatcctccttgccgatgacgctatccgcctggaaagagagctgcctgacaatacgttttaccagcggtaaatacgcattcagatatttcccttcctctgcggcggtgagcgttaagcacgcttcaaattctctattttccattatgattattgaaagaccattctgctaataaccacatcatcaaatggcatcggcacatttaatcctgcgaaatcttgcttatattcattcattagctggcggcgtaaatctaaaatagaggtatggcgcaccgcttgataatccatattggaaagtaaattcactgttgtggcttgaataaccggcaccatcgcaatgacatttttaatgtctttgtcatcaccggttgccatgcctaattccagttgcaaatagcgctcggcgttattgtctttcagcgtaatcaccatgttcttaatttcaacaaactgaaccgctttattaccacgaacaaaagatgggctcaccgtggcaggttgataccccattttttttaaaatcgtctcgcgggaaaataaaaaaacagcgattaccccggaaattagcaataggaatacccgcattttcatcgaaaatgcttttttcttggtcttcatcaataatcctttgtagtagatatctttatatcgttattaggagcgtcccatcatcggcatttttttctgcctgactctcaaaatgttgtgcagccagaatatcggcttgcccgtgatggctcggatgacgctgttgctgttgttgttggctattagccgaaacctgtacgttaacttcagcactgttttgcccaatcagtgtttggcgtaattcagcgctactttgctgtagtgcccggtagacttcaccttgattggcattaatattcacctgcaacttaccgccctcaaaatgaatcgagatatcaatcttgcccatatctggagggtcaaggcggatcgtggcatgttgtacgcggctatcagcctgcacctgcaagcgctcccctaatgccatgcgtaattgttgcggccactcttggcggttattagccaaagtgagtgggctatcaatacgcgaggcggtgctggtttcattgctgccgcttggtacattaccgctctgaacagggctaccgatttgcacatggctatcgatttgtgcaaggctatcgatttgtgcagggctatcgatttgtacagggctattgactggcacaaagctatctatctgcacctgactcgcgcttggcccattgcggagaagcggaaataggctctcgttttgtgtcagggaccgtttcggtgtagaaaggctgacgggcacgctatcactgagtggcgtgggctgctcgccttctgatctcactggttggaatgcctggctctgcactgtgggtttgagtgccattggtgacacatttgcaggctgagtttgcagcaatgcatcaagcagttgctgattttgctcatccgcagacagggtcagatcagcctcatggctatcaaccgtaccttctgcatcaaacgccgcgataacctcctccaccgccgcagggcttaacgagattggctgatgtggcaccagcgcctgtgacaaaacagcatcaaaattcgccagattgctgacgctgaccccctctgggcgggcggtagcgggtacttttatctcctcctttgttagggcgaacgaatccgttacctgagacagtgtgttcagcgtggtcgtgttcagcgtgatcatcttagcggccctcttcctgtgccatatcatggtaggcgcggatcgccgtagcggcataggcactgatgccctcttgccggttgcgcatctgttccatatcggctttaaggacttgttgataagcctggcaacgctggatagcccgttgatggctctgttgtaataatttcaatgactgaacagaatctgacgataccttctgtttggcgatagaaaccagcagatgagccacgcgctcatccaccagcaacaagcgtggccaatctttgctctgactcacgctttccaattcactcgacaacgcctcagcggtagccaaaatagtcatattaatgtttcatcccttcccaaccttgatataaggcggttaaaatcccttcgacttcagcaataatctcgatagagagcagattactggcctcatataaacgataaacacaatagtcgtataatttgctgatagtgaccgataaatcaccgccatcttcataattcagtacgctggttaagccgttaagaatattaatacatttattaatactcttaactttatgttcataacgcccggcctcaatatgccctttagcacgaattaactcatccctcaggccatcaaatagcattataaccaattgatgtggcgttgctgctgccgcctgaatatcaatatccgtttgttgatataatcctgccatcggttcgtcatacatcataaattctctttatttctgctctttttctggttcaaataatttcatggtaacgttcattttggagatcatagcggctatccccgagaattttaccaaatgagcgtcatatgcccgtttatagtcgttatcaaccgcatcaatctctttctggatagcgctaatatccagactcaatcggtcattatccagcttgaataaacccgatgtggcattgatataaggttctaatgactcggttaatttattgacgaccccattcttgccattgaagaattcactgaaatgctgcgtattggctttcagcgtttcttgcaattgtttgctgtcgatggttaattcaccgtcccgcccactaatcacaccgaaagcatgaatacgttcaccatcaattgggcttctgataatgttattcaacagggtactgatggcactggcattgggtaccgaggatgaggactccaccagtttttgcaattgattaaacttggagacgaacgttttcagttgatcttcactggcctcattatcgatttctacgcccacctcaaccgcaaccttttctttctgcaatgatagggtaagcccctgaattgccttatccaatacattgctgtcgtgcgttattttaattcctttattctgttcccctagccagacaatggcatcttgcccggcggccagttgctgctctattgcactaagtttggtggttaaatcactcacatccaacgtatgggccgcaccgcttttattgctgctcagcgttaacaccacatcactgccggtacgcactaatgaggcggtaattccttgcccatcgctatttttagccttgtcactggcattgttaatggcattcgctaactcttccaggctatttaccgaggttaaatcaacggttaatttggttttacccacggacagctctactgggcctgttgctgcctttaatttgtcatcagtaatacccttcagagcaatctggtctgtcttggctaattgctcgacgaataaatggtatttgccttttaccgcttgtgcggtcgcactggcactcaccagcttatcgtcgctactggtggtttttatttgcagtagcccagaatcccgttggtttaatttatttaatgccgaacggaaatcggttactgccgtttgtaatttattgacactcgccttctggtcattaatttgtttttgctgtgccgccaaacgggctttcttactggcgaaggttttattagcactgatttcggccaacttttctgggtcaaccccagatatagacaaagacataataactcctattttatattttatttttgcacttcacgttaagcaaaattcatgccaacacttaattcattgatatccattgaatttatttaacgcagggaaataaatattccgcgcatttaataacagcggaaataaaacgttgataaaagaataccgctccgaaaagcggtatcgattaagttcatggcctattatattaacctggcaaccggtttattagccttgcagcagggtcgaaatcaactgcgtcgcggcgttggcttttttcagcatcatcacgctcgattgcattaacatttcgctctgcgcgtggtttttcatctcatccgcaaaatcggtatctttgatgctgcccagcgcctgcgcggtgttgctgatcatgttatccaggttgttggaagaggattgcaggcggttttggttcgcccccagcgtggcacggaaagcgccgtaggcgtcaatcacgtctgacagctttttatctgccatcatcgccagatctttatccagtagttgcatattcatcacaccgccaccggtagagtttttagcctggaataggttttctgccttctctgcggcagcatgtgctttgcccattgctacagcagcaccagcaatctctacgagatcggctgccgttaggtcagcactagttgcgatagtccttgctctgactggctgacctgcctcattaacataagcagggattttatattctgttgccagcttcttaccagaaccggcacctttagtttgagcgtctttcgttgcttcatcagcagcctcttttgctgccttagctgcctctgttgccttatccaaatcatcagccttcttctccaaagccgtaccgcccgaggcttttttggcaacaggcgttgttttctccgttacactatcagccagcttttcaatcacgtcattcagatctaatttcaggctggatcctgcatcggtaccgctttggaagttcaattccttacgcattttgccgccatcagcaaacagcttctcggagttatattcggtgttgttcagcgcgttttgcagctctttacccaactcggtaaattctttttggatagcctcgcggtctgccgcagagttggtgtcgttcgccgcctgggttgccagcttcttcatggcgttcagggttttgaccgattcagccaagccaccatcggcgatttgcagcatagcgatggattcttgaatgttctgcttagcctggcccgcaccgtttaaaaacttctccatacggttagtgatctgcaagcccgccgcgttgtccgctggtgagttaatgcggaaaccggtagacaggcgctgtgaagatttggcattcgccaggcccgcattactcaggctgttgatagctgttttagcagaagcattagtgtggatagacagtgccataagttcaattctcttaaatgccggggctacctgttagctcccgtggtagtaaaataaagcggcaccggaggggggattattaaacctgatatgcaaattatgttgtgatgacgattagtgataccactaaaacaagtttagcgctttaataacgcaggttattaatctgatttgaattttaagaaaaataaagacgacacaatggcataaaaaattaaattatttttttaaaaaaatcattatttattcatttttgaggaatgaaacatcattcaggccggatacgctgtcaaaaaaccctataaagaatgtaaagttagccgtatataggaaaaacacttaactatcagaaaacaaataaatttattaaaatattgattatttaatatcatttagttaataatacatagcaatcgagaagaatagttaaccatccttttacagcgattaataactaggaaattttctcgtaaaaaagaatattataccaaaagcggacaacaaatcgcgggtttgcctgttttttgaacccaccaataataaccctatctcctaataattaagcagaatttatcttttaggtaattaaattatcaaatcatggcaagcattttgatactattatgcacacaataatcgaaaaaaatatgaataaacaatcccatatcgtgaatggctggctaatcgatctagcatctggctttattacccatcaagagaccagggaaaaaaaacgccttggtgaataccagttgaaactgatcaacgtattactggaacatgctggcgaaattttatcccgcgatgagttaacaaatttagtctggaagcgccgagttattggcaataacagcttgcccaatgctattcacacactgcgtgtcgcgctgggtgatgaaaataaacaacagcgcatcatccagaccatccccaagataggttatctgttggatgccagcttttgtgaaattatcgacgccacaaaagagacagaaactgcggaacagatagcattggcccaaaccgatgatgaagagatagccgcaccattgaatggcgtcactctccacgaggcggtagcagcaagttcatctgatattgcccatagctggatagcggagactaacgaaaaaccggcagacacggcgatcaacgaccccttacccccaacacagaccgggccggtggtgatgactcgtcagcacgttacggccagtcagcgcccaccgtggaatattttcagctattggagccgggtggctattgcgttattggtgctcatcactgcggtcgctttttaccgtttatttccgcagaacaaaggggtgagttacaccgcgattgagcaagatcaggaagcgtacagcaatatccgtctgtttcagttggtggacagtgcgctgtcgctacagcaggaagagaaacttaatcaacgcttaaaagacactctgtataccataaataaacagagtaaagccaagagcatgagcattaatatttattattacgtctctctcagacgcttggattttaccttctcggtagaaagtcaatgcgagaataaacagttagggatgaccatttaccattggcgtcagaactctcagttattaaataatttgatttaccgtgaaatggagagaaaaataaatgaaatggttaactgctagcaatggaatactactgtcaattttagggttattcctttcactggcagcactggcctcttctgaaggaaagaaaaagcccactcttgccgaggctcaattacaaatgggtttttatgatttactgtcacagcagaaagagatctatgacgcccgtgttaccgcgacccaaggtggtgttattagcaccattaccagccctaatgataatcgttttatttttaagggtaagtttactgaacaaaccacccaaaatggtcagttgagtttcagttacagccccatctttttcaataaccccacgtctggccgcatgattgaggggtttctggattatttaatgcacaataccgtgtttatgacgccaatggtggttgaagggcaacctttattggtggggcaaagcggtattgtcttgggcgagaaataactgggcgtgagaaatagctggggctgaaaaaacggctgacatgtgcgatcaacgcacatgcagcttgaagaataacgggtaatgtttaccttgctgcaacaccaagtacgttgggggacttgcagttgcagccgtattccccctcctcacccccccaataaatttctcaccatagcgctgcgtgcattgccctgcgccgttaacatgttggcccacatcgcatactgggagcgcccttgcagtaacttttcagctaaggcttcagcggccatcaacgcagaattgggcgcagagaaactggacatgctattgatttgcaccccggtatttctcttgtgttcgctcaatttactcatctgcccggtaatatgtcccatcgcttgctgaatacccgccaggtgttttttggcttcctgcggcttcgcagcaatatcacgcacccgatcttccagcaccacttctggttgtaatttcaacggttggaagctctccttggcaaaacgtaacccgccaccccggacctgaagatgggcctctatctctgcccagcgcttttcatccacatgaaattgcgcattcccttgcggatccagccgcccgtggatccctaaacgccctaacccattattgagacgtaaaagattttgtgccggcgaagcataagccggtaatttgaccgctacgacgttatatccattgcctgtcagcgaaaataacagtgtttcactttctgccggttgcaaaagctgctcggctccgtgcaaagcgaaattaacctcggtacgttgctctggcacaaaattaagttgccgatcaacggcattacctgacatcgcggtgcgttgttgcagccaatgtaaggtttttaatgccaggggtttgatttctgtctccgcgcgttcttgttgcagcgcacgttgcaattgtgccacctgccgctcagtcgtatgtaaatacccttcagcccgttgtagtgcagtcagttgccgattaagttgtacgttataacgcagtggctggctggaaataaaaggtgactcagggaaatcgacctcttttttaattaaaggaagtgaattagcgccctgaagccgatcgaaatccgggaggctggttttattcgccacctcccattgcggtctattgagtcctacctgcataacatcccagcttaaattaagttaaaaagtgacaagctattaatctgtttgaacgtcgtatagttggcattggtcaccgtcatcagattcatcaattccatataagactcggctaaatccaggccaaccaaattttcttgaatagtggcattcgacagctccatctcttcatggtttttttgcagtaattgaccctgtttctgtctgatccctaactcggttaaggtgacccccatatgatcagaggcattatcaattagccccatcatctcatcaattgccgcggtatggctggctgccgctcccggcagagcagatttcttaatatcatcacacaatttttttaacttatttagcgtggctaatggatcagttttatcggagaaacccggctgtaaatgtacattatcagtaatttttacgccttcaccaacgcccgtttggcggttatcgctattaccaacatacgtatatttatctgccgttttgtcaaaggtaattggctgtttattacttgctgtccctgcaaacaaatagcgcccttcactatttttggcatttaaccctgccaccaccgattccagcatgtaattcaattcatctgcaaccccagagatatctttattactcttaacgctatcattaatggataacaggctactctttatcgagaccaattgtttattaattgccgagacatgcccagtttgattagccaggctgttagataacccactaatattactgctgtattgcttgatgtttacttgttcacgattgatctgtaataaccgggtgctggcaatagggtcttccgatggcaaggtaatacgctgttgtgtcatcatttgcttgtttattttctcaagctttccattgtgctgagtaataaatcgattcatcgtagatgacatggttggagtgctgattctcatcaatattcctttatgagtaaaataataattagactaaagccaatagatcagaaaatagcttatcgccagtcgcaatcactttcatgttggattggtaagcccgttgatactccatcaaattcatcgcttcttcatcattatttacaccactaaaactttcatgatagcgagtcgcttgatttaaggtattttctgcattttccagttcgctgtgatttctattactggtgatggcgatataaccgacgagcgcggttgccgcatcgtccaatgccacattcttcatgccagtcacaggggtttgtctaatatcgagcagtttaaataaattactgttatcacccgcaggttttccgcgatcagctaaagctagctgttccgccgtaatggcagacagttgtaacatgccattcggatcacccgcattaaagacaaataagtcttgcccaggagcgccagtaaaatccgtaccttttccgagctgatcgttgaacttatcggccactgttttagccatctcttgcgttgagtcctgcaattttttcagcgtggtgagttcataatcatttattccccccaattgccccccacatgacatgttcatgccctgtgtggcccccgaaaaatggagagtgattttagtatccacagaggaggtatcaaccgccaattcagccgccaccgcgccattcactaacggctgcccttgttttacgctaatacggtaagtgccatcttctgcttgattaacctgtgtctcgatcaagccactgagtttttttatctggagttcctgcttgtccaataaatcgttaatattattgccatcagaacgattttttaaaatctgttgattataatcagcaatactgcgcgtcaagctattgatctctttcaccgtaatatcacgttgctggccaatagactttttttgctgaacaataaagttgttcacattattaaaacgcagcgccatggcattagctgactcgataacctgctggcgcatcgggggtgaatccggcaattgtgtcgcggcactgagagaggaaaagaaattatttaaccccgttgccaaactggtgctctcattggagaccatcaactctaccgcgttgagatattgttcacccgcatcgtaatactgttgctggctatttgcccgccactcttgcatcaccacatattgttgggagaggcgtcggatcccatcaacattaaccccatttcctgcgttaacgcccccctgcccatctgcgccaatggcactttgttcagcccgctggcgcgagtaaccgggggtgtgcatattggcgatattcattgatgtcgcatttaaatgcgcttgcgtggcctgcatcccgctaaaggcggttctaataaaattcatgattatcccggcatttgttgaataagtaacagatgttgaataaatagcaaatacgctttactccctataagcgggcaattgatcgccaaacttaaatcggtttgataagccgttatttactgctcaactgctggatcaacaaattagcaatgccactgctgcgctgtgatgccaacgtggaggccagtttgtcatcgtaaaaatcacgcatcatgcgctgttgtttactgttaaacgggtcatcatcggcggccagcacctcggcggctttgcgcatctgttgcaataacgtgcgcataaataccgcttcaaactgcaccgcggcttgttccaaatcttgcggctggaggtcaccgacaaaactccccggtatcaccggggatgatttattaatggcttcaatcataggttgtccttaaataaccactaattctgcgtccaaggcaccggcttcatacagtgcttgtaatatcgccatgatgtcatcaggagaggcacccaagctattgatggtgttgacaatactgcgcaggcgagtcccggcaggcaccatcaccatctggtttttccctttggtcacttcgatgtcgctttcaggggttgtcaccgttttaccgccccctaacggattgggttggctgacatttttctgctcacgaatattgaccgtcagattgccatgggataccgccgcggcacggaccatcaccccttcgccgatcaccaccgtcccagtgcgggcattaaacaccacccgcggtgactgctcgcccgcattgatttgcacatcttccagcaatgacataaacgccacgcgcgcaccggcgtcttgtggcgcattgaccataacgttagtggcgctttgtgcggtggcggtattggcaccgaaagcccggttcaacgccagtgccacattgttggccgatttaaaactgggccgtttgagattcagcaccacttggttgttgatttgaaaatcactggggatctggcgttcgatgctcgcaccattgggaatacggcccacggttggggtgttcaccgtgacactgctaccgctgtcaccttcggctttaatgccgccgaccaccacattcccctgagccaatgcatacacttcaccgtcggccccgcgcagttgggtcaatagcagcgtgccgccacgtaaacttttcgcatcaccaatggaggaaaccgtgatatcgatcgattgcccacggccatagcccggcggtaaggtggcgctgatcgccacggcggcaacgttttttaccttagggtccattttctccggcagttgcacgccaaactgacgcagcatgttagccattgattgaccggtaaatttcacctgatttttatcaccgctcccatccaagcccaccaccaggctgtaccccaccagttggttgccgcgcaccccttgaatatccaccagggatcccagcggttgcgcgcttgccgtgggtaacacgagccataacccgagcaggacaaagcaatgcctcgtttttatcaagcccgacaagaaccttatcgagaccgaaaaaaaccgtatcgaggccgaaaaatgtatccggtttaaaaacatgtcaagctcctgcctaaattgggaatagcggatggttaaagaagcgcgttaaccaaccggctgagttagcatcactgagcgcaccacgaccggcataggagatacgggcgttggcgatgcgctgagaagaaaccgagttatcccgtgccacatcatctgcccgcactaaaccagtaacccgcatatattcatcgccctggttgagggtcagccatttttcgccacggatcaccaagacgccgttaggcaatacctgatggaccgcaacggttatcgatccacgcagcatattttgctgtgctgaggtggcactgccgtcaaaatcgcgcttaccggagatggagccgccgaatttattcagttttttgcccaagacttccggtacccccaagctcatgtcattctttttgccaaagttggttttggcctgcttgctggattgagtggattcatccagtatcacggtcaaaatatcgccgatccggtatgcacgccgatcctgcaacagcgaccagttgtaagcgggctgaaacagcccccctccttccgttaccgtcgcgggttgaaccagattggccggtggcgcaaattcggcatcatctttttgtaccaacagcgcggggctttcacagccacacaacgccagcaccattggcgtcagtattaaaaaccttttcattcgtcattcacttttcaaaagagggtgctggcgatcacagcttctggctaacaaatttcagcatgtcatcggcggcagagaccattttggcgttcatctcataggcccgctgaacggtgatcatatcgaccatctcctcaaccacttgtacattcgagccttctaatgcgccttgttccaattggccgaacgcctcttcacccggaacgccctctaccgcttcaccactggccgcggtttcacgatagaggttgccgccaatcgcttccaaaccggctggattaataaaattcaccaaggtgatttgcccaacttcaacgggttcagtttcccccccgacggtggcggtgaccgtgccatctttgccgatgtgcagttgtttgctccccgtaggcagctcaatttgtggtatcagcggcatgccctgtgcattcaccagtacgccatccgcgttagtggttaaattaccggcgcgggtataagcaattccgccgtccgccgtttcgatctggaaaaagccctgaccggtgatagccacatccatatcacccttggtcactttgatattgccgaccgtgaactgtttttgggtgcccacaatttgcacgccactaccaaactgaataccgctcggtgtagtgttattttgatccagcggtgcgccgggggtgcgctggttctgataaaacagatcggcaaataccacccgatcacgtttgaagccatcggtgttgacgttagccaaattgttcgaaatagcgcccattttggcatcttgtgccgccagaccggttttactgacccataaagcagagttcataactgttattccttaatttccatattgagcaagtggcgcagattgagacttcaccgcgccatcgccattaactgccccggatcatccggttgcccgcttgcgccagatcctctgcaactttcatcattttgatttgcgcctcaaactggcggctgagggagatactggcgatcatttcgctaatggcagaaacgttgctgctttccaggtgtttattcaccacttgcaccgtttcatcacgggccgccgggccacggttactgaccagtaaaccgcggttattttttctgagttggttagcggggatatccaccagtttgatgcgctcgatctcttctggggttttgatcccccccgcctgcgggatgatcgctatcgtgccgtcatcggctatcgataatgccgagtaaggcggcaagacaatcgggccgccatcccccagtaccggcaagccattgatggttaacgccccctcggcgcttacgtccatttgaccattgcgggtatagacttcacggccaccgctgagcaccgcgatcagcccctgatttttaagggcaatatccagatcacggccggtttcttgcaaactggcgggggtcatatccaccccggcattttggctcagtaccgcgacacggctgttataaccaccgcccatgacctgggtggcggtggctttttccagatcagcacggaacccctgcgtattgctgttcgccagattattggcatggatctgttgttgtgacaggctgcgattcgccccgctgacggcggtatacagaagcttatccattacagcacctggaacagtgcattcatcatgctgtcattggtgctgatgattttggtgctggcctgatagttacgctgggcggtcatcagccctaccagttctgcggtgatatccacattggaattttctaacgcgccggattcaaggctacccaataaccccgtgccaggtgtccctaacaacgccgcaccggatttattgctctcgctccagctcgtgccattttgcgtcaccaggccatttgggctggcgaagttcgcgagtaccactttgccctgcaacattctttcgccattactgaaggtggcatacaccgagccgtcactttcaatccgttcaccatttttaacacccgaggtatacccatcacttttattacgagtggtggtaaacccttggctaagctgcgtggtgccggtgtaatcaatatcgatatcataatcagcagcacccgctggattgaaagtgccatgaagattaatagcgttgcctttcaggacaccagcagttgtggtaccactacctgaaatcaactctccggtagtggtgaattgcaatgtcagaggaggagtcgccgctcccccatcaacggtatggtgaaccgcccactcactcgcgacagaacctgcaggaagagtcgttgatttaacaaaatagtgagcgaccgcatgttcccgccccagagaatcataaaccgtcgacgtcgtggtgaagttgtaacttttctcattggtaggattgaaaacgctgactgatggtgccgttacactggcattcagattagccataaaatcaagctgttctgatgctttagctggcacacccgcattgttaattttcaaatcactgatgatgcccgcctggatattaccggcagcatccgccgggtagccctgtaatttcatgccctggccgttaaccagatagccatccacatcggaccggaacatgcccgcgcgggtataggccttatcccccgagctttcacgcaccacaaagaaacctccgccgctgatcgccagatccagccccatgccagttttttctttttggccgtctttgctgatattttgtgacacgccgctgaccgcgacccccagtggctgcgactgagcatacatagacgaaaattcagtacgactggctttaaagcctttggtggccgagttggcaatattgttactgatggtgttcagttgttcggtatgtgcattcaacgcggtattagcgatactaaaactcataacatatttccgtataaataagatggattaatagggtgatattgaccgtgcgggctaggccccgaattgtgtgatttggctgtatgaaacctcgccaaggccggtaatattcagttgcgctgcaccaccttgtggtgaaatacgcacgttgttcactttgcctgccacttctagcggaatcagttcttccccactgccactgacggcactcagttggtattggccgggttggagcttggccactgccggatcaagcgtgaaattcaccggacccgccggttgtttacccaaatcgataaccttttcttggcccaagatgtcagtgatgtgcagtaacagcgtcggggcaggctgtttcagcgttaagcgcccggcaacacggtccttacctaaggtaatttcatggccttcaaccatcacttgctgcccaaccaaattggccgttgccatggtctgcattttcgccatctgaacggtattgctcttgagcagctttgccatgttctccgtggcctgaacctgcgagagttgcgccatttggctaacaaactcggtaccatctgccgggttcagtgggtcttgatttttaatctgcgccaccaacaaggtcataaattggttatttaactgctcccctcccggcaggccaccttcaggtgctggggattgattgccaacattggctgaatttctgctttcattaatctgcatagttagcgctctccaagctttaacacactctgctgcatgcttttcacactgttcaatacttcaacattggtctcaaagctgcgcgatgctgacatcatgtcagccatttctgacaccacattcaccgcaggataaaaaacataaccttgcgggttggccattgggtgattgggctcatagcgctgtaccgagccgccaacctccaccacatccaagacctgcacttgtgcgctctgaacgcctcggggatcagccgctgtgcgggccgaatacaccgctgaaaacaccgggctgcgggctttataaaccgttgcagcagacgccgccggtgattccgcattcgccaaattactggcgatggtatttagccggatggtctgagcggtcattgctgagccagccacccgatagatttggttaaaagacatccttatttcccttcaattgcctgctttagcccggtcaatttcatattgagaaatgacagactggtctgataatcaagggcattttttgagaactcggcttgttctacgtttaatgccacggtgttgccatccagtgagggctggtagggcagccggtactttatttgtggtgacgacattatttgtggtgacgacatcatttggggtgatgacatttgagctgatgacatttgggttgataacatttgagcggatgatctgtcaggcgctgccatcaccccattccctctttttgctcgttgcatttcagcggcaaagtcaatatctttagcctggaaatttggggtgttcacattggctaagttggctgatagcagttctgctctggtaagtcgaagctgcatcgccatagggtgaacccctaacgctttctgaaaatggatgcccacaaaatacgtcctgttttgatgttaaaacacagttgttgcacgaaatcacaccactcaatgcaactaacgtgccaggtttataacatcatgattaatagtattttttatttttattgctcgccaaaatggaaagttaacttccgcctgtcggtgacatttagtatccgcgtccgtcactgcctacaaagcctgttgatctgtggcgcattgctgtgtgccaacaccatttcagcggctgaaaacaacaccagaaaacaggtttatacgcaggctctgcacgccgcgacggccgatatcgcccaaaccgccaagaataaaaattggcagggctatagcgtcaaaatgaatatttttattccggcagaaatcagccgttataagccgtgccaaaaagcacttcaggtcgcattgccaaccgcagaaacacaacatttatcgcgtttgcgttatgagataagttgtcccgatggtcagggctgggaagtggtcgccacggtaaagccggatatttatctgccaatatgggtggcaaaacagacccttgagcgcgggagaaaagtgcaggcggatgacatcgaattgaagaagaagaatattaccggtgttcagggcggctatatcaccgatccagacgaaatcctcggtttaaccatcaagcgccgtattcgccagttgcaagccgttatcccctcgcaattagaacagcccgttttagtgacccgtaatcagcacgttctgatgctggccgcgcaagacggtatcgaggcccaaatgttagggatagcacaaaaaaatggccgcaaaggggagcttatcaaggtaaaaaacctcagcagtggccgagtggtgaccgccacggttgatggcagcgggcgggtcagaatgctagggctgtccacgccctaggggtgacttaatcatcaagttacgtttcaggcggccagctaagtttgagacagtaagttaagttagaggtaataagttaagtttcaggtggattgttccgttttaatcagagtgtgggcgttattcgctacaactcgaatgacttagggtatacgcatttagcgatttaataagttcacggtaatttaactgacaaaaggtgattttagatggaaattaacacgcatcggcgacgaccgtttgtcgcccaaccggtgagtaccgatacagtatcagccgtcaaagcgatagagccgattaaaaccgtcactaacaacccccattacgcaacctctgacctgcatgcccaactggacgcgatgccagaagtagacagtgaaaaggttgatgccgccaaagctgcaattctcgcgggaagaattactctcgacagtgcagctgtcgccagggctatactcaacttccacgggagataatctgttatggagccgacaccacgtgttaaacaactgctgatagacattcaggaagatcgtaaacgttacatcgcgctggaaaaactgttaatcaagcaacgtgaactcatgattggacataaaactgaagctttggaggctttgaatccacagctcacagaactgtatagcgttcttgataatacagcgacggaacgtcggctcctgatgcagcaattgcaattaccggcgaataaagaagggatacaccagcttctctcgcgtttaccaacacattaccgcgagcatgcgggtgcgttatgggcggacctgcggttacgggcgcacgcttgccaccagcaaaatcaccacaatggcatgttgcttacccaacaaatcgccttgttatcttcattagctgagcagcctactgagtttctttacgcgggctaatttgatttctatatctgtgagcccatgtcgtctgtaaacttaggtctataaacctaggtctataaacttaggtctataaacttaggtctgtgagtttatttccgttaacctctatccccgtcatacttcaagcggcatgtgcattggctgccttcgctcacccagtgacttactgatgtaagctcttggggattcactgagcgaccgccttcctgcaactcgacttatttagggtatatatgcagtagtcactttatggattgttcccacccaataaaaaatccgtcatagagaatattccctatgacggatttttttatggtcgcttgaggtgagcgatattaaatatcgcccgcctgctgacgttgccagcactgtgttgccagcgcatcggtatttttttgcgccaaccgcccctgttcacgttgatattcttcttgttgttgttccaatactaccgccacgattttttcacggcgagcctgctgttgcatctgtgtctgtagattgccaacctcgatatcagccagtgcctgctcctgtttttgccagtcaatcagccgttggatatggcgctgatagtcagcgtgattcgccatctgtaacgcagaaacaccggggaatgcctcctcagagagggttaaggcatttagtgcattgatattgcgttgatagcgctgacacaactgtttttgctgcgttaactggctggtgacctggttgagcgagcgctgacgcaattgctgaagctgttggagtgtgtcgatcatatcgctcatgaattacgcctcgtcagtgggggcaaaggaggggaacatcccggttagttgttcaacgctggcagaaaatagtgccgggtggcctacctcctggcgcagaaattgggtaatcgccgggtaataatgcaccgcctgatcagccatcggatctgcccctgccacataaccgcccaatgggatcaaaggtttgatcgccatataatcggcatagcactgtttcagtagactggcggctttggcctgctggctaccgataacctggctcatgcaacggctgatcgactggctgatatcaatcgccggatagtgccccgcttcggccagtttacgcgataacacaatgtggccatccaagaccgctctggcgcaatcgacaatgggatcttgttgatcgtcaccttcggccaatacggtataaatcgcggtcatggtgccgttaccgctgctgttaccggcgctttcagccaatctggggataatgctaaaagcggacggcgggtagcctttggtggcgggcggctcccccagtgagagggcaatttcccgctgggccatggcataacgggtcagtgaatccaccagtagcagcacatcgtggcctttgtcacggtagtaggtcgcaatggaatggcagagttcggtggccttgatgcgcatcagcggtgactcgtcggcaggtgccgccaccaccacggatttcgccataccggcggcctggagtgagtgctcgataaactcttttacctcgcggccacgctcgccaatcagccccaccaccaccacatctgcctgggtatagcgggttatcatgccgagcaacacacttttaccgaccccactgcccgccatcagccccacccgctggcctttgccgatagtcagcaggccgttaatggcgttgacgccgacatccaacggggtgtctaccgcccgccgttgtaatggatggatttgcggtagttgctgttgcagtggcgtactcccgcccagttggcctttgccatcaatgggttctcctaacccattaataactcgcccgagccagctatcgccgatcaacaactcaccgtcctgctcactcgggaacacccgcgccccgcctagcaccccaccgggatgcttgaagggcatcagataggtgatgtctcgatcaaacccaaccacctgcgcctcaataaaggtctcatcgacactctcaatccgacagcgctggccgatagccaaacggcagccgacactttccagcaacagccccgtcactcgcactaaccggcccgccactcgggccagatgaatgttttcgatagatttcagggcatgatcgagagccggagattcactcatggtgaggttccgtcaaaaaactgctgtgcaacgcaccaatgcattgatccaaacggtgctggcaccccacatcaatttccgtggtttctgtgacgatacggcactcaccgcccaccatgtctggatctgccgccagcccccacgcttgcactttttctggcgcaacatcattaatacgaccaaattctgccggattcagatagaccttgagttgctgtggcaccatgggcagcgccgccaacgcctcttccactaaggttagaagctgtgcgggttgcaacgccagctcacagcggatcacctgccgcgtcactttctccaccagttgtaatagctcatcccggcggcgctgctcataggtctctaaataggcatgtagttgggtgatatagccgctgaagggtttaatcacatcattaaaactggctaactcagattgccgcccctcaatgcgcccctttttcagcccgtcatcatgcccaagacgcaccccttcctgatagccttcctctttcccttcggccagccctttatcaaatccctggctgatcccctcctgaaagcctgccatcagttgcttttggtattctgccggatccagtgtctggtctgccgctgacggggccacctgacgcactttacgtagcggtggaaactgatgaacccgcagtttcactgcccccgcccgtggggtattttttatcgacatcaccttactccatggtctgttcggcaaacaactgcacctgaatctctccagcttccgccagttcccgcacctgcgccataatcactttgcgaatgtgttcgacacggctaacaggaaccgcccccgtccgctgcgtcgcattttgcaactgctgaatctggcgtttaggcagcacgtcatagatggcctgacgcaatgctggctcggttcctttcagggcaatggcccaatcactcatcgggataagatccatcaagcgctgcaaggtggcttcactctgacggctgaggatgaagaactcatacatctcatctttcagttcattcagcacctcttcatcacgctcacccaactgatccagcaattgctgttgattgccgggaatgcggttaacgatattggcagcctgtttgataccgatcactttggagccatgctccgaaagcaccgcaacaccacgttcaatcaacctgtccagctcatccaccacatcacgattgacatcatcaagcttggcaatgcggtacaagatatcgtcctgacgatctttatccagatacgccagtaccgcggcggccacatcagggggtaaaaaggccaaaaacaccgcttgtaactgtaaatgttcctgatcaattagcgccaccaactgcggcgtatccacccactgtaaccgcgtcatacgatggcgaatttcatcaccatagatgccgttaatcacacttttagcaatatcactgcctaacgctttattcaggatcgcttgcaggtaactgcgtgacgccccattgatgccactctgctctcggtaatcctgaaagaagtcatccaacgcctgccgtgcttgatccagtttgatgttatggagccgtgacatcatctggctcacacacaccacctcctcacggctcaattgttgcatcaccatggcggccgcttcttcaccaatactcagtaataaaatactggcctgttccaatcggctgcgccccttggtatcacttttgacgcttgagtcatcattcaggttgagatttgattcgttcattactgttaatccattgtttaatgacttcggcggtacgttcagtttctgactgcgccaattgttgcagatgggcgattttggtttctaaaccggagccttgctctggtagatcgtcgcttttccaaagagaagatgcggagaaggcattttctgtacgcgggctactttctgcaccgtctacaccggtatccacatgatcaagcgcctcatctgcactcgccgaggaaatggctaacggcaggttctccgaacccttacgcgaatagcgtttcatcaatgggcgaacaccaaacaacagaaccagtaatgacagcagcccgatccccagcaattctgcccaacggaaggtacttggctcttgccaccacggcatcaccggctcgtcaatcaacgtagggaccgcgaaggccatcatgttaatggtcagagaatccccacgtttaacatcaataccggcggcatcttcaattaaacgtttgagttcttcctgctgttctggcgtccactgttccaacaccgggagcgatttattcagcaccaccgcaacggtcattttctccagcttgtaacccggataacgcacatggcggatattgcgatcataaatatatttacgctgcgcctggctgcggctgacggcggctggcgtttgacccgcctgagattgagggatgggctgattgcttagtgatccggggatccccatcgccatatcgtcgttgctgttctcctgctggatattttcatcattgattcgagggtccgggccatagtgctccgccgtctcttcaatacggctcatatccaactgggtagagacactgatgcggtagttattcgcgccaatcaccgaattcaacaggttcgcgatattcttctcagtggtgctttgcaaatagtgagctaattcggtcccacttttcacactgggcaccccctcactgttcgcttgataagcttgtgacaataattcaccgtgttgatcgaccacccgcacattggcaggtttcattccgggaatactgcccgccaccaattggacaatggcccccacctgttcagtgctcaatgtttggccgtatctcagccgtaacaccaccgaggcactgttatctgcatgattactgatggcgaatgaactggcttcactcatgcccagatggactctggcatattccaccgcgctcaatgccatcatgctctgcgccagttccccttccaggctgcgcttataacgaacattttggataaactggctgctgccaagcatgctttctttatccatcaactcatagccaatggggagtgtggcagtaattccttttgctgccagcaagatacgcgctttacccaactgattttcagccactaacacctgaccattatccgggtttatgcgataggcaatggcctctccttccagcacttccaccacttgggtgatcgggatattctcctgcgagccaaacaatgccgtgtagccctgtgagctacgccagaggctgaaaataatcgcggcggtaaccaaaagggctgccgcgctcataagaatgatttttgtattttcacctaattgaccaggtgagaatttctgcttaattttatctaacaccgatttaccctacagcgcagtattcataacatcgtctaatgcagaagtgagcttattgcgcacctgcaccatggcggagaaagccacactggctttctggctcgctaacatcgtgccggttaagtcgtcactgatgcccatatccatcgcggtctgtttctcactggcgacgtgttgtagctggtccacactcttaatcgcgccgttaagcacctgagaaaaagagagattattggcccccttttccacggggaagaacgggctattggttgcggctggctggattgtgccaaactcaagaccgctgcctgccatggctgccatttgccgcatttccagcatcactggcgattgcgagcgagacatattgatagaatcaatgttatccatcctgcttccttattttttatgagtgacactcaatgtcgataccatcttcacgcatattggcgagccgatatcgcaaagcacgtggcgtaatacctaaaaatgcggccgttttagatttattaccctgatgccgttgcagtaaatccacaatgtattggtactgcgccaagcgcccacgcaacttaatattgttttccccatcagggggctgaatcgttgaaaaaggtaatgatgtttcccctactggcgaggatattccctgtgccataggtaaaccgaggctgggcagttcaatcacgccgttgttgctcatgatgataccgcgttgaataacattctctaattcacgaacattgccaggccaggtgtatttatacagctcacattgcgcttctgcggtgatatctatttttacattcagaaaactttggtacttattaataaataccttcaccaaaggcagaatatcctctggccgttcacgtaaaggtaatatatggataggcaccacggataagcggtagtagagatcctgacgaaaacgcccttccgcgatttcaacactcagatctttgtttgttgaggcaataatacgaatatccaaaggaataggcttatgaccacctaaacgttcaacttcttgctcttgcaatacacgcaataactttacttgcagtgccaacggcatatcaccgatttcatccagtaataatgtgcctccattcgcctgctcgaatttccctgcaacactggcgatagcgcccgtaaaggcacctttctcataaccaaataatatggcttccaacatgctctcaggtatcgcggcacaattcaccgcgatatagggtgaggcatcccccatggctttctgatggatatatttcgctacacactctttaccggttccggtttcaccggtgaccaacaccggaacattaaattcagctaccctacgcgcaagggaaaatacacttacgctggaaggcgcattagcaacaaatccatgatcgttttttggaaaaacatcaacattgatattcatcataatttatccacacgtcaaatcacaataaatcacgtccgacactcaatagatcgacaaaataaattgagacttaaacatcattgaaaaaataaatcgtaacgtgttacatattgttttggtgagttatagaaattgtcgataactcactatacatcccccataaaaaacaaataaattaaataaaaattaaaaacattaaccaccaaaaatcaatgagttatattaattgttaaaatatcaaaataaaaaagaaataaattaataaataaatacctattgtatagtttcaccataaaggtttaggctaaaaaccatgaaaaattgaataaaacattccgtcgccagtcattctttcagcagccatgttttcagaaaagctcgcaaagaaagagagaaagagaagatgttgtttagcctctacctctatgtttcaatttatcaacataggttttaacttatcaacataggttttaatttatcaacatagaaacagacactagccaaaatattttggatgaaaccatgcaatcaaataaagtcaaagcaaaggtctataatcatgacccgcgaccagacatcgtatcgcttgaaattaacaagcttggccgccctcatcacaaaatacctaaaatagtcaatagctatttttctattattgagagcgaaatcagtctctattttttaaaaaaatacagaataaatattacgcttgatgatattaagttccaaacaaattgcagtcataagaatgccaaaatgctaaccagccagatgggtaatatcgcattcgatatcgaccgtctgttgttacttaacattcttaatgactactatggattaagccaagaaaaatatggattaagccaagaaaaaaaaaccacgaccacgggaaagctatcaccgctgaccaaaacagaagaaaggctaaaaaacaaactcgggcttgaaataaccgatctctttcttaatcagccattttttggtgaacacctaatcattaacaacagcaccgctgcgttaatcgcgtgctggtcataccgtattgatttttttctaaaagattataacaaaagtggattcagcatttttattgatgcaccacatatagataggcttatcgataccataaagaccaaaagtgaaaaagcagtagaaaaaaatgtctcactgtcagagaggcaacttgaatacttagtcaaaaaattacccgttacgctcaccagccaattaagcaacattaacctgacactggctgagttaatggccttaaaagagggcgatattatttcagcttcattgcccgaatatttccccgtatttattggcaaagaagcgctattcagtgccgccattaccgagaaccgcggcaagttattcttttctgaatttaatgaccaacccaacgagatgaaccatgactgaccagcaaattgaactcaacaatgacctcgactttacccttgcattggatgagagcgccattagcccaactgagcatttcgattcggtgattaattcaccagagatcattaatacgccagaaaaaacagcaacaaagactgatgagcaaaagcgcaaaatgtcactgttcagccggatccctgtcaccttaacactggaagtggcctctgttgagatccctctgtcagagttactgacggtgaataatgactcggtgattgagttagataaattggctggcgagccgttagatatccgggtaaatggcatcatgttcggccaagccgaagtggtggtgattaatgaaaaatacggcctgcgtattattaacatcaatagccaaaatttaggtgaactcgcgctatgagccgcagccttcgagcgataacaccggtgaccatcatcagccgcggcctgctggtgggcgggctgctgtattcccctcttctgctggcgcaggagggggggatcaccctgttcaataccgtacaaaccgcaacggggcaagattacaacgttaagattgaaatcctgatcctgatgaccctactcggtttgttgccgattatgatgctgatgatgacctgctttacccgctttattattgtgctggcgatattgcgtcaggcactggggttacagcaaagcccgccgaataaagtcctgaccggtatcgccctcgccctgaccttgctggttatgcgcccggtgtggaccaaaattcatcaggatgcggtcattcctttccaacaggatgaaattacgctttcgcaggctctgggccgggcagaagcgccgttgaagaactatatgctcgcgcagaccagtactaaatcactggatcaaatgatggctatcgcccaagtcagtggcgagccacaacagcaggatttgagcgtggtcacccccgcttatgtgctcagtgagctgaaaaccgctttccagatgggctttatgatttatatcccttttctggtgattgacctgattgtggccagtattttgatggcgatgggaatgatgatgctatcgcccttaattgtctcattgccatttaaattaatgctgtttgtcttgtgtgatggctggacattaatggttggcaccctcactgccagcgttcaggggctatagcatgatgaccacggatattgccggtgacattatcgccatggggttacatttggtgctgatgatttctatcgttgccatcgtcccaagtctgttaatcggtctattggtcagcatttttcaggccaccacacagattaatgaacaaacgctgagctttttaccgcgcctggtcatgacaatgttggttctcatctttgcgggtaaatggatgatgatcaaactgagtgattttaccgtcagtattttccagcaagccgcacagttggttgggtaaatgccgatgggaatcgatattcatgccatgacggctccgctattcgcactctggctaccttttgtcaggattttgtcgtttttgcatttttgtccggttattcggcataaagcctttacccgcaaagccaagattggcaccgcgctgttactggccattttgataaccccaatgatcagccaaccggtggtatccggggagttgctctcgatagaaaacctcttattggccggtgaacaaattctgtggggctggttatttggctccatgttgcatttggtactagccgcattagaggccgcgggtcagattctatcgatgaatatgggcctgggtatggcaatgatgaatgaccccaccagcggagcatcgacggcggttatctcacaaataatctttactttcagtgtgttgattttttttacccttaatggccacttactgtttgtcaccattttgttgaaaagtttcagtagctggcctatcggcgaagccatcaatgatttttcactacgttcattggcactgagccttggctggatcctttcatcggccacgctgttagcactgcctaccacttttatcatgctgatcgtgcaagggtctttcgggttactgaaccgtatctcccccacgttaaacctgttttcactgggtttccctatcggcatgttgtttggcctgctgtgcctgctgctgttagcgatcaatatccctgatcattatcttcatctgaccaatgagatcctgactcagtttgaacggatgaaggtgcactgatgtcgagcagcagtggtgagaagagtgaaaaacccacagcggggaagctgtcgaaagccagaaaaaaaggcgatatcccccgttctaaagatgtcaccatggccgcagggttagtgacctcttttattctgctatcgctatttttgccttattataaggcgttggtttctcaatcatttgtgtctgttgctcagttggcaagtcagcttgatgaccaaggcgctcttgagcaatttctgctagccaatctgtttattttcgccaaattcttagccacgctgatcccgatcccgttgttcagtatgttggcaaccttaatacccggcgggtggaatttcaccccggtaaaactgatacctgacctgaaaaaactcagcccattggcgggtattaagagaatattctctgccagcaatggcactgaagtgcttaagatgttggcaaaatgcagcatcgtgctgtacaccctctatctggtcgtgcatagctcacttgatgatttattgcacttgcagacactgccactagaagaagcgattacgcagggatttgcccagtaccaccatattttgctgtatttcattgcgattgttgtcgtttttgccgccattgatattcctctcagtcatcatctgtttaccaaaaaaatgaaaatgaccaaacaggaggtcaaacaagagcataaaaataatgatggtaatccagaaattaaatctcgggtccgtcaactacaacgccaatatgctatcggtcaaattaataaaacggttcccagcgccgacgttattattactaacccaacccatttctcggttgcattaaaatatgcccccgaaaaagccagtgctccctatattgtcgccaaagggaaagatgatattgccttgtatattcggagcattgcgcaaaaacacaaaatagaaattgtcgagtttccaccattagcgcgcgctatttaccataccaccaaggttaaccaacagatacccgcccagctttatcgtgctatcgctcaggtgctgacctatgtcatgcagatcaagtcatggcgttccgggcaggcaagcaagccggtattaaacactcaccttgggcttcccaaagagatgcaacgattccatgatgaaacataaattatatgatatttctcgtctgttaaaagagacgcacattgcagtccccgtattattactgtgcgtgttggcaatggtaatattgccattatcacctctggttctggatattttattcacctttaatattgtgatggctgtattggtgttattggtcagtgtgaacagtaaacggccgctggatttttcaattttaccgccgatattactgatcgctacgctgatgcgtttaaccttaaacgtcgcctccacacgcgtggtattactcaatggtcatgaaggggctgatgcggcaggtaaagtgatcgaagcctttggccaggtggtcattggcggtaattttgttgttggctttgttgtctttatcatcttgatgatcatcaatttcgtggtagtgaccaaaggggctgaacgtgtttctgaagtctctgctcgctttaccttggatgcgctcccgggcaaacagatggctattgatgcggatcttaacgccggattaattaatcaggaacaagccagtattcgccgtaaagaagtggccagtgaggccgatttctacggcgcaatggatggcgcatcaaagtttgtacgcggggatgcggtcgccgggatgatgatcctggtgattaacgtgattggcggtatttgtattggtatttttaaatacgatttgagcgccagccagtcattccagcaatatgttctactgaccattggtgatggtttggtggcacaaattccgtcactgttattggcaactgcggcggcaattattgtcactcgagtgagtgatggcggcgatatgactgatgaagttaaagatcagttattggctaaacccacgatcttgtatgctgcggcttttgtgatgtttattctcgctatcgtgccggggatgccccatctcgcctttctcagttttaccggattactgctgttcgccgctaggcagcaaagtaaaaaaattcagcaagcagatcttaaccccgattttacggccttaaacccggttatttctgacgaaaataccctgagtatcagttgggacagtattcctgcggtcgaacccattggtttaaatttgggttataaactggtcacgttggtagatgaatcaaagggtaaaccgttgaaccaacggctacgtggcgtgcgacaaatcatctccgaaagcagcggcgttttattgccagaagtccgggtgcgggaaaatttccgtttaaaaccgtcccaatacaccatcaatattaatggtgtcaggatcgcggggggggaagtccatgttgataagctcatggctattccaacgacacagcaatacggtgaggttgatgggattttagccactgacccgacttatggtttggccatcgtgtggatagacccgcaagagaaaccgcaggccttaaatttgggttatcaagtggtagattgcgccagcgtggtagcaacacatgtgaataaggtggttcgggagcatttatctgaactgtttaactatgacgatatcaccttattacaccaacggcttgccgcactttccccacgtttggccgaggatttagtcacgacactgaattttagtcagttattgaaagtgtatcgccaactcttaactgaaaatgtgtcattaaaagatattgtcaccatttccaccaccctactggatagcgttacggtgaccaaagatgcattattgctgacctcagatgttcgctatgcattacgtaatgggatagttaatagcatcaatggcgatgataaggatctggcggtttataccatcaataatgaattagagaatatgctgttaagctctctgaatcaggcccaacaagcggggaaagtggtattagataatttcccggtcgatccgaatattctgacgcaattacaacagaatctgccgatcattaaagaacaaatgaaggcagaaaatcaccagcctattttgctggttacgccacaactgcggccactgatatcccgctatgcacgtctgttctgttctgggttaaatgtgctgtcgtataacgaaatcccagatgatatgaatttgaatgtgattggggtgctggagtagtcataatttgaggagagggtgggagggatttagtgatcggatcaggtttcaattgatgtttaggctaatcaggagacttgttcggttgtcagcatctcaccactcaccaaaacgctataaacgctataaacgctataaacgctataatagtaggtaacagtaatgataaagaacaataacaacgacaacatggatggataaaatgaaaataaaacgtgctgctggactgcccctgcttctaatactcaccgcttgccaaaccccccctttactgcagtcagcggaaataaacaagagagccactcagggaaaatggagtttcacatttgttaccccagagtcacagcctgcacaggtgacctacgcccgtatagtggacactgcagataacctgcacccgtttaatacacgggacatgacacaaaatagcccatctcaaatgggagagtcgggtgaattaatacaccaaacatcgattcattttaatcagacgaactccccgcctcaatctatggtgttctgctggaattcgattgccgataaaaaagtgtacgagacccatctggttctcccgcagtccgtcagacaaagtatgatcacacccgccagaacagggaatacaacccaatataaaacgatgttattgggcctttctcctggcggtaaagtccttgtctggttacaggacgagggaggcccgcaaaataaccgcgtgccaatcgtgaacatcaataccctctccggcgataaactggcgatttgcaagagctgacctcgcaagtacggaagaagagggatcgccacagtaagcgagtatgagattactgtggcgattttatggccctgtaccagattatagctaatcagttatctataaaactttgttgccattcaacaatagtttttggccttttatttttatctgcagcaacattggtaaagtagtgaatttgtaactgaccctttttatccggtgcaacgtaagccgcccaatactgcccagtatgggtatacataatgatagaagcacgcttattcgccgccccccgcacccaggtagataacactttggctccctggttatccaaatcattagtgtaaatatacacattggcagattgaacaaactgagcataatgctcaccgactaaattacggaaagcgtcatcgaccgaagcctcagaaaaaataccaatagataataacgttggggccttacggggatctttttcagcacgcacatattgcccgtcgatgaaaacatctttcggcatggagatacgacacccccaactgccattactgtgcacctgtagcgagccatcttttccagggatcagtaataaccgacaattagccgtgttctcaatgacatcaacaacggctactccttctgttttacgggcttctgcatgaaaattacccatattctcaccagaccatgcacggctatccagactaaatccccactcggtcactcgatgaatttcgataaccccaccacggtcattacctttagtgatatttcaccattgcccatcccagttaaagttcttatcaacatcagacattaaggcaataccttgcagatatgcccgctggatacaactatcactggtacaactgttcagcgatttttcccatgtttgacgctgttgataaaccatttcagtattgtatttcaccaataagacttgataaatgctgttaaatgtttgatccagccagtgtaaatcctcattgctgcagactgtatactcgacgggggttgaggctctttggcaattaatagccaaagaagatgttgagataagcatcatccacagaaaaaaaccaccgcgtagggaaagaatattcatttattagcccataaaaaaataaagttatttattattattaaggaataataacaattatgagcagtatattaaaagattactatttagacaaaacattgttaatccatataaaaaagatggttatacgtttaagtgctcacaggagagcgatatcatccctataatagcgcccgcctttaaatgttataacattgttagatttaaccttttggtcgtatcaccgtgctataacaaacagaaatttcgattgaaaaacagtcattttctccctatttttatgtaaaatatatttttaccaataaccacgcaattaccattgatttattaaacgttatttacacattaataaattttcagggaacctgttattaatgcgagataaattagaagtaactactttattaaatggatattatcttaaaaaataacatactaaccgaagttaacattaagggattatgatgaaatatgctagcttcgggtttgtatcagctatttaggctatagactaaaataaaaataagcagtaaataaaataaagttgattatcatgaacttattattattagctgagtgaaatgcccatttacataatcaggatattaaaattatcgctctatttatcaaagtgatacatgacatacccctataaattcattagagatgaacaataaaaaaatattattgccaattatgatgttcattactattatttcgttatattgcccccgccgtacattacgtgccatgtcttaacattgtcatattatcattcgatacaaatatcattattggtaaattttattgatatatttgctgatttaccctcaccaaagagaaggataaaacaccgctatgttcctttatatgacctatattgagcgtaaaatacgccactctctgtttattagtctcggctgtttgggtcttattttatctctttccggctgcgaacccgcagaggaaaccaacttccatccattccctatcgatgagaatcacagtacatcatcgccgtggtcccgtaccgtagacacagtgaaaggcccggtgacactcacccataagccagcccgtatcgtctccaccagcatcaccattacgggtaccttgctggcaataaatgcacctatcattgccagtagtgctaccgaacccaatacgacgctagccgataataaaggattctttactcaatggtcggatattgcacgggcccgtcacttaatcccgatgtaccagaccgaacccaatattaaagctgtcgctaagatgcggccagacttaattattatttccgccactggcgacgattccacattggaattgtacgatcaactgtcggccatcgccccgacattggtgattaattacgatgataagagttggcaagaactgacactacaattaggccaggcgacgggccatgaaggggatgccgaacaggtgattgataaatttgcccgccgactcaatgaagtaaaacagaaaataaccctaccaccgcaacccgtttcagcatttgtctatcaggaggtgagtggtagcgccaaactgtggacggaaaattccgcacagggaagattgttattggagctgggtttcacgctggccaatgtgccagacacgctgaaggacaacacccatacagagcaccgtaaagatatcattcagttaggtggagatgagctagcacagggcctgaacggtaagactattttactcttttctggcgttcattctgcaattgacgcattgaaaagtaataagtttttaaccaatcttccggcgattcagcacgataacgtttatgcggcaggttatgacactttccggttagattactacagtgcgaataatttgttgacgcgaattgagtcaatgtttaagggaaaaaaggacagcgaacccacctatcatgagagcagaacctaacagcataaaaagcgacacttattggtcgcttgaggttattgacaacgctattcttagcctcgtgagtgaagggttgaccgcaccgaggggcacttcggtggcttacgccactacgaccccaacggcacgtttccccttcaattgactttgccagcagtctgaagcgacacttattggtcgctttttactgaccgctaacatggtatgccacttaagggtaggcgacggtaaagattgcatccgctttcacattaccgctctttaacaccccttcagcgcgaatatagcgagcggttagatttaaaggcatgctccctcctgcggcagttgaggtaccaatcaaaaattgccccgcattactggcgctgacactggcgttttctgcgccaaatgtcaccagattgccgtcacttttttcaagcacaaggcccacaccggtcgccgtgctgctcggtgataaactcagtatattggtacggttagccttgttactactgtcggtaaacgtgatataaggtttagcgtctttagcgcaactgcccagtgggatcgaaaaagcttgtccgcccacccggtcaccttgcgtttgtagggaagaggtatcaaccggatccagtgcaaccacaatatcggtcgcccccagatcacacgtcgccacggtgggaggtggcaatacgatatcggttgccccgatattaaacgtcaacaaatcaccacaacgtgagctaccagtagcaacacttctcgtcgtccagacctgagcattacctgaaactaacgcaaaacttctcgccacattaaaccaatgaatcactcccccttgataaatactggcatcagtcacaatgagttggaccgtgactcgattagcaatcgttatttttgtccctggtacaaacaaggactgagttgccttctctgtattcccccattcatatcccccgaataaagcgtcactgacattcaccgacatcttcacccctggaacaccggtagaaacaggcataaccgcccccccagcaagcatcgaccaaccaccgaggtataaataatctgctgtcgtccctgtttttgtgaatgtcgtgacgacactgaagttcatgctccccaagacaaaaccattcgtcaacgtgactggcagtgcttttatgacaaacggtgtttcccctccggcccccgatacagcaagagaacaagagttaacttgcagtgcggcaaaactcggtttactggtggtacataacaggagtagcaacaacagcagtcccgccttatacctctcactgcgtaacgtgaggaatatattttttttcattgatggttctctctttcaaccggtttaaatcgctttagctgcccggcaagtgctgccgctgcaactgaaactcagttctggtcggccaccataatcgttaatgtaggtcaggacgggggcggtgaaactggcagatttcagctcagcactggatttgggcgcaaccatcaaaggttgaaaattgctgtcagccgatgacttacctttctccgccagcccaacgaccgtaatgtaatagggagtggggttctctagccgaaaaccttgcgccgttttatgcagaaccagttgttcctgccagatttggcccgtagcaggggtaatcccttctggccggtagaacagtttgattttggtttgtaaggcaatctgcatgacattagatttttcactgcgaggcggaatttcacgcagattgaagtagaacagtgactcgcgatcttgtggcaatttcagcgcctcaggggtggcagagatacgcaccgcgcttttcttacccgcttctactcgctgaactggtggcgttgccactaacggggtggtgactttttgctgttgttcattctcaatccacgcctgtgctaaatagggcagtgttttattttcattactgatattcaggctaatggacttatcctgcccgttataaataattcgcgtccggtctaatgcaatcgcagcattggcggtataactggtgaataccactgtgctggtcaacgcgattaatgagagcttcttcatggtatatcacctcaatattagttaacggatatgcagggtaataatatttgcgcctgcggctgtattactgctgggatcgccacctggcactgcttagcaccactccaaacgacatccagtgtttctcctggctccactccactcaggtaagtaaaaccgtcatcgctaacgatccccagttcctgccctttggcactgatgaccaaactaccaaaaggcggatggctactgtcggtcaggctgatggttgccagtaccttctcccctttcatcatggcgaaacggcgataaccaatagccccttcggtcagggcgaactccaccgcagactgcttaacttcaacatcatcagccaactgattgatatcgatacgcgtatctgtacggtagtagctgttaatattattcagcacagcaataccaaaacggtttgaacgaatattccgctcttccagtgggacgccagcaatatcatcggtattgaccatcaggcgggtgccgccactcataccggggccgtgtaatgccgcacctttcgcagtaaccgtcgcgcccccgcgcatagaaaccccggtcgaggtaaaatcatcctgcacataagcgacattaaggctggtttcagcaatgctgctgcgatgaatataaaaaccgctgaactggccgcgcgcaccattatcattgctgttgttaacccctgcggataaccggtagctgctatcgatagccgagctgttagaataattcacggtctggttgttcccttgaccattatgttgcccgctgtagctgagggtttgttgattgcctaatggcaccgaaaaactcagatacagcacatcatcattcacgccgttatttttgctacggctggcagaaaggttgaccgtcatatctttgagagaaaaagcatcaaaagcgtggctgaccgtcgcgctgtagctgttggacgtgggctgatcccaataattctggtaactgtatgaaaaattgatattggtctggatatcaggaaaatttttactcgccgtcaccgtatacatttccttgttgcgcccaaggtcattatcgaaataacgggtgccgagatactgattcatcgacatgaattcacgttcaaaaaaacggttccccgccagcgagatatcactgttcagttcatcaaagcgcttggcatacctgacgcgcaacgatttcccgctctgcgtctcttggttgggaaggcccgatgcacgggtttgggtgatatccgttgaaatggcaccaaatgcatataaatcacggccaaccccaaccgacacggcattgtaatcacccgagccaatggccccgccaaacagtgaccagcgattactgaccccccaagagaattcgccactggcaaagaccgggccttccgtcccatgattcagcgttgagggctggcccaccgacgttttatagcggattgcaccagggcgggtcagatagggaaccgcagccgtctccacctgaaaagtttgtaccgtgccatcctgctcctccacgctgacatccagccgcccggaaacagaatcactcagttcctgaatacgaaaaggaccggaggccaccgtggtttgatacagtatgcgcccctgctgggagaccgtcactttggcgttggttctggctatcccgctaacctcaggggcataaccgcgtaaattaggtggcaacatacgttcatcgctggacaaactggctccggcataacggaacgtatcgaaaaggctggaggcgaaatagttttcaccaacgctcaaggtagctgccagtgacttgatcgcccgatacatatagatccggctccagtcaaatgtactggtagacgaattctgctcgccactgctgtggctgtagttcccttgataatcgccccgtaaccgccaagggcccgcattcagacccgacgtaccgttgaggctgatattccgggtggaaccactctctttcggcttactaaacagcgagttcacgttgtaatccaacagaaacccagggatcccctcatcccattgagaagacggcacccaattgctgtcactgtattccatccagtcttgcggaacattgatagctaacgtgctggtcgctaaatcaacctccgtggttaatcccgccagctcacgcaaatctgcgcattgcccctcatgccagaatgtgatcttttgcagcacatcaggcttcagaccaaactgttccaccaccgcttccggtaggcacacctcactgctattcggttcatcatcacgggcataaaaagcgatcacctgctcgggaatacggtgattattgacgttgatctccaaccgatactcacccggcatgatatagccaacgttcgtaaaatgagaaagatcaatattctgtttgtcgttagcatccattgcatcagtattaaaatcaatagcactgactgctccactgagcatgatcaatgatgtagtcattgctataggaatttttttaattattctcattcagttactcaccagaaaaatctgcccgtaataacatcaactggatatgttgtaagaatagctaaaaatcatcatgttatgtgtgatgattttccctacttaaaaaataaaaattacaacatagtgacgttactgtgattttagatgtaactatatccattcataaaaacagaaccagattaactttatgaaaaatataagattaataacaatcaatatactttttatttttttcttttcatagaaaaaaagcatgtggcatttctccacatgcttttttaaaattttagtgtttaaaacctgtgattaattataagcgagggtaaagttagctacgctgctgaattcgccggggaccacactaccttcatctgcactggtacctttcaggtaagcagagaatttcaggctgttactgccctgatccagggtcttgcccaccgacgccacaccacgtttaattgtcgcacccgcttcatcggtgatcacaatacctgcaccatcagccaaaccaatcagtttcaacatctcagcatccacaccatcgggtgtgccatcaaaggtgacagacacattcttcatcgtagccacatcacatttctccagaccaatgctgaaactacgtggttcagaagagcccatgttagccagtgatgcagtagaaatctggcccagttcaacaacctgatcagccgcttcggaagtaattgaacaaggtgcttcaatgatagaaccggtaaaagtcactttacccttaccttggtcagcagcatgagcagcgaaggcagaaagagacaatacagcagcaactaatacacttttcttgaagttagacattatataaccttaatttaatttgaagttttttcattaatatagaaagaccttattatcgcaaaatattttatctgcggaagcgtcttactacttattataatgaaataaaaagatgcaattatcgttacagccattttaaccgataaaaaggacatccattccttatgggaaagtcaaatcgataaaacaggctgtcatattcagttaatgcgtcatgcgttaacacgactcattattaaaggagagatttcgggagactaatgactccctacttagcgacttattaattcagcccctctcgaccatgtgaagaagtatacgcgattctttccgctggtaaatagagaattggcgggcatttagcgcgtaaagagactttacatatgcgtattaattccataaaaacatgaaaaaccagtttatatgaccatcaagaattatcttggcaacagaaacatccagaatattaaccataagtaccacactgcggttacaaatataatggtggtaaagtcataatatcagaaataacattaactctctctgatttgacctacacatcaaatatgaatagggcgagttatttgtgggaattttcttacttttctacgatgacatctcataataccgtttatataccctaaataattcgagttgcaggaaggagacaaattggccgggaactgatttaaacagcatttataccgcccgcagggggagcctaggggatggcactgtgctacatctccacattttcgttgttatctggcctgatctgcaaaacatggaacaaggaagtcacttatcaccttccctattcgttcaacagaaccacatgaaatcaggccttgtcagtatggatgttgtttagtgacatccagcacacccaaaaatgaaattgcactttgtcccattaaagacaaatatcattcctgtcgattaatcatatttattactgtgtcacatcagttataaaaatatttatttcacctaaatatactttatgaaaatagcattttcatgttttgaggtttacgttcaaaaactgacgggggccatcatggtaaggattaaacgacatacactcaacgcattactgatgataatgaggaaataattatgtccaaaaaaaatgtaaaaaaatcaccggtccaaagagtcgatattaaaaataaaaaaatatttatggggttctggcacaattggacatcctatccggcaaatggctataaagatgggcagtcgaccaatataccgttggccgatattcctaaagagttcaatgttattgccgtcgcctttatgaagggaagcggtatcccaacatttagaccgtataacgggtcggatgagcagttccgcacacaagtggataaactgcatagtgagggccgctcagtactgatctccttagggggggctgatgcagagatctcattaacatcccaagacgaggcggcctttgtcgcagagattaaacgattagttgatgtctatggttttgatggtttagatatcgatttagagcaggcggcaattagttataaagaaaactcgacggtaatccctcgggcattaaaaacagtaaaagactattacgctaatttaggccaacactttattattagtatggcacccgaattccctcacttaagaattaatgaggcatatgttccttatattaaggcgttagagggatattatgactttattgcgccacaatattataatcagttgggtgatggcgtccacacggatagcggagagtttatcgctcaaagtgataatgagcgaaaagaagattttctttactacttaactaaaaatttggtttctagttctcaaaaatttattaatatcccagcagataaatttgttatggggttaccggcaaataatgacgcggcaaataatggctatgtcattgataaaaaagatgtgcataacgccttcgccagactggatgccgcaggtttatccattcgaggcctgatgacctggtcaatcgactgggacaacggtaaagatgtccaagggaaaagttataattgggagtttaaaacacgctacgcctccctgggtaataatgatgatggcagcagtaataataatctcccattggccccctacaaccttattcaaacttcaaaagcggcgaacagccttgaattatcttggcagcatacgcttaatgtcaatgctatcagctattactccattttccgtgatggcaataaagtagggacctcgacgaatacaacctttacagataccgggctagaacccaataaacaatatatctataaagtgagcgctaccgactcacaagggcaaatttctgatttcagtacggtggtaacggcaacgacgttaacgaccaacctttctgtctgggagaaaggccaatggtacaacgataatgattcagtacggcataacgcagaaaactatatttgcgtcatgcaacacacctcaaacgcattctggtcaccagatcaagccaccacattatggcagctcgtcgtacaacgctaaatttcgcgggttcggtaccttataccctaaagaattccactgaaaaaattaatattattaaggaatatatgatgaaatacagaacgcccaatattatcagccgcaacaaaagtaatggtatctcttcgtttcatggccacgtgttttctcccgcttcacgtgcctattttgcctggctagcaggtgaaattgatgaaggtgcccttaaccaacgcgagtccggtaaatttttccctgaaacagccgataatcttcccgatccctctgcagctgatgatcagcctaatagtttgcccccattagacggaaaaatcgccagtgctggcgaaagcactgggcaaatgttggataaccctggcagtcactggacaaaacatgatgtgttagccggggatgtattagacgtatcatggaattattccatgaaacataaaacccgccgctggaaatattttatgacgcggactgattggaatcccaatcttcctcttagccgagctcagtttgaagataagccgttttttatggttcaactgaatgagcagccacactggtcggtagattcagagtttgcattaatgcctctagacccaacaatacatgagctaatactgccgcagcgcagcggttatcatgttttactggcggtctgggaagtcgctaataccggcaatgctttttatcatgttattgatctggacttcgtgggggaaggtggcagtgatcaacctctaccgcctgcaaacctacgtgcgactaacatcaccaaggattcagtatcacttgcctggaatgcttccgtttccgatgtcgctcattaccagatttatcgcgatggcgtcttcttggcgcaaacaactacattgaactggattgattcaaacctgaaagccggtaccaaatatatctatacggtaagcacgatcgatacaacgggcatcgcctcctctctcagttcacctttgttggtagaaacgctagcggagaacagtgacaacgcaccgccttctgctcctaaaagcttacatagcatgaacgtaaccgagaacagtctggagttgatgtggggaacatcgacgagttcgactgggctgaaaagctatctggtctatcgggaaggggaagaaattgctgaggttctggcaccacaatacactttccaagagaccggattgtcaccagataccacctaccgttattttgtcgcagcacaggatactcaaggccgtttatccgtaccgagtaatgtccattctgttacaacccatgccaaatctggcggtggcggtgatggtggcggtgatggtggtaatggcagcatccaccctgcctgggaacttggcgcgacctataacgctggcgataaagtcaataatctcggtagagattgggtgtgtctcgctttccatatagcccatgagccgacctgggctccaggggatacagactaccacacgctttggacgctcattccgtaatcgctgttttgataaacatagctaatgagtttagcgataaggttaataaaagggtcagcattgctggccttttacttttatttttactcttactgcctcacccggcagcaccgattaatccggtgaaccgtctcaaaaaaatgcgcatgtgcgtcctgctattgatggcactgttgcaaataggcagtggtgataaactgagctctctttttacagaaggagcagcatatgaactcctttccatggccgacattttcaaagcgagataatcctttggactgttcgctggtactgtaaatatggtagagcactggcgctgctgaagcgtgagggcaagtgtccacttggtgttgagcatcatcttagcaacgtgattgaatgcggccacggtaagctgaagcggataattaatccgatgttaggcttcaaatccataaagaccgcttatgccacaatcaagggtatagaggtgatgcacgcgttgcgtaaaggtcaggctaaaccctggtattatggtcaccctcagggcgaagtgcgcctgaggaactacgttttcagtctctgaagttttaacctgagaggaaacttacccttagcgactatttgcaacagtgccagaaattgtgccgtttatgatcgccctcagttaattactcaggccatcgatagcctctcgtttaaattactggaagagtttttggtcgtagctttgccttactgacatcaatcccaacgtgatacatggtttacctcaatcaggcggtaaagcagactcagccctaagcctggtctctccggtcttagggcttttctttattctctcatcacatctcaacctgaccgccagtttagcgatacagaaaacaacagcacgggaagctaatcattccgtcccgtgagcgttgggcaatggaacaaataaattcatactcctttactcaaaatattctactgatcagataacccctattttacctaaccgtaccctcacgtcattttcgcctaaatgcccccttcttattacatcttatttatccattacattacttatataacacctcacgacaactggtttattaaagaaacacgaagaagtgcaaagaatacagaagaacaatattgagggttatataaaatcacgtttaaactaacaaaaataaaaaaacaaacaaataagatcagataatgaaaaaaataaatatgaatgcaatcaagaaagagtacaacttgttactcaccatcacaccatgagaaagtacgccaaaaaactcattaagaatattgaaaattaaaataaagacaattcaccacaatctcaataacattattacgaccacattatgaccaaggttttcttttttccacacaatatgtcgaaagaagaaagcaacgcgaaatacagcgatgcgacataaataataataaattgcataaaaacattagaaacatacacagaccactcacacagaacaggtagccaccagtatggagaaaaatgagattgtgtttaaattagaaggcgcggtgctattctctccggaaaaacgctgcttaagcgggcccggtggaacagtggcggtattaaccgaaaataatcttagatttttacaactcttgcttaatggtgtcacagagaaagaagagattatcaacgaggtgtggaaagagcaacgaggggctatcagtgagagcagctactatgggcagttgtatatgctgcgtaaagccttcctacaggtcggcctaaaagaatcgctgatacacaccatcccccgtaaaggggtgcgctataccggatcgattagccaggtagcgataaatagcaacccagaaaatcaacagagtagtgagacggctaattccgtttctatcatgcacgatcctgctccgttggcagtagcgaccatacccacagatgccggaaccatgacattatcctctccccccactaagcaaagttttttacacagccaccgttggaaaaaactgatctcattattagcggttttttctttctgttggctctcatttctctcagctttagtcattattatcttattaaagggagagtgacttatcgttaatattaagagtgagataagtgtaattttaaaagactaaatgataattaccatgaagccaaaaaacaaaaaacaccgttaaatagttagcactacgaacgaggcaagaaagaaaaaattcactctagtctggcagtagaaaatgaacgccacggtgctcatacaaaacataacgggtacaacacccataactattttaaaaggaaacagtattatgatgaacttcatgactaaagcttacgttaccgcacaagttaaagcacaagccttcgcacaggataaccgtggttctattattgagtatgtgatgatcattgcactggcgggtgtctttattggtctggcaaagccagagctgacaacattaattagtgagaccattgccgcagccaaaaaatcggttactccataatattattagaaatatatatggtagccatcggctaccatatttttcgcctcactattaggtctgacgatggatataattagattctcgttaatggtattaattgtctctcagctattatttgtttgttacagtgacatccgccacagaataataagcaataagtttgttattagcattgcattcaatgccattatattgagcctggtaatgcaccatactgtgagtatcattattcctatcgtcgccctatttatcggctatattattttccatttcaatgtgatgggcggcggcgatgtaaaattgatcacagcactcctgctggcactgacggcagaacagtcattaaattttatcatctacacagcggtcatgggcggcattgttatggtggtgggtttattaatcaaccgcgttgatatccaaaaacgcggggttccctatgccgttgctatcactgccgggtttctatcatctgtactaatttaagtggctgaaataaattgatttatcacgatagcatgacaaaaggtacgaataatgaatcgaaaatttcttatattattttcactcctgattgttgccatcggaatctccggcattctgttaaaccctgataaagagatacctgaattactgactcagacggagaaaagaaaagagagaaacattgtattagcccaaactcgccatgaccttaccgccggtagattaatatctaaagaagattattcattacagaatatcatcgtagatgaatcaagtgacttggttaaaaatgatctatcacatggtcatagaattgatagtgatagcattgatggtgatagcattgatggcgatagaacggctgacgatagaactcatgatcacagacttgatggccatttattaaaaaacaatattttagcgggatcgtatattaccgatgaaatgttaatctcgcccagtagtcgtgaattttcccggctaaatttaaaacacggggagatcatttataaattttacattacagaaaaaaacgaatacctactaaacaccttaaatccaggtgacgttctttcattccaattactgacacttgaaacgaacaaaaccaaaggaatggaaaatggtattgctattgatagcaagagtatgaatagtaaacaaaggcaaaagtattcacttaataacgtgatacctgacatgccgatattaagcattaaaacgtactctcctgaggaattatcagtaaaaaacaacaaaaacaataagactgaagcgtatgccctaggatatattgaagtgataatgaaaatacaagacctcgaattcatccatacggtggaaaaagccggtgaggtgtttttaacccccaagagtggtgatcacagacgaatagatttggatgacataatccctacattacaaacaataagagagctaagaggatgaatgtatataaattaaaagataaaaaacaaaatataattttattcttgtctattgttattctctattttttgtttgaaaattcagctaacgccaagcaaatttatctgcctattggtggttcacatattataaaaatgcaggaagagatcgatactgtctttgtttctgctgctaaaacagctgactatgaaatagttgataataacagtgtaattatttatgccaaaaaagaaggcttggctgaattcactttgttcaataaaaatcatcagccgataagtaaaacacgggtgttggtgaataatactatcaatgatgcctatcgaagaatacgtacagagtttcctgatagtaagatagaaataaataaaataggcgaaagctatatacttacgggcagtgccgaaaccgaggaagcaaaagataccattgccagtattgtcggcgaggcgactgcaagtaaaaaagaaaaagagagagaagaaagttatcaaagcaaccctgaatatcggggtgttattaataaaattaaattacctcaagccaatcaagttaatgtaaagctcactattgtagaaataacgaaagattttactgaaaacatagggctagattggaattcgataaaaagtgcagcaggcgcttttcagtttttaaattttaatgcacaaagcatcagcacattagtccatgctattaatgatgaggcgatagccaaagtgttggcagaaccgaatctatcagtcttatccggtgaatatgcctccttcttggtcggcggtgagatcccgattgttagcaccaatcagaatggtattagtgtcgaatataaagagtttggcattaagttaaacattggtgccaaagtgaatgagaagaaacgtattcgtgtcatgttgggtgaagaggtcagcagtatcgataaagtgtttaatcttagaggtggggactcctacccttcattacgcatacgtaaggcaaataccacagtagagttaggcgatggtgaaagttttattctcggtggcctgatcagtagtactgaacgggagtcgcttaaaaaaattccgtttattggtgatgtccccctactgggtgcgttattccgtaatgcacaaactcagaggaatcagagtgagctggtggttgtcgctaccgtaaacctggtgaaacccgtatcagcaaggcagattgagctacctgattttatgcatacctctacggtagaacgttttttcaatctgaccaatatcaaagacgctaagcgtagaaagcaggcgaaagaatttctgcaaaaaggaggttttataaaatgaaatggatattcatcataatggctattctcttttctactagaggcattactgcgttcacaattaaaccgtccgctaatgagtactcttatgtattaataggtgaatatttcaccaataaaactgaaaagcatccattttctcttaaattaaataacagtctgccattagaattaaattgtaattatatgaaaaatgactaccggaataaaaataatgatgttcatgggtgtgctgtttataaaaatagacattacgccattatcgagtcatggaataaaaatttataatggtggtagtatgcaattaattctcaataaagatttaatcaataaaaaagataatagggaaaagagtgctgttgtcattatctcaacccgaaaagggttaaaagataaaatttccgaatatgtccgattggctgatataaaaaacatcaaagaaatagatgatgatatttttagcgccgcctcaattttgataccggataatgtgaaaggaattataatagatataaatgagaatcatgatatcaacactattcttgatctaatgaaagttcatacaccacgggactgttggtgtatattagtcggtgatatagactctattagcatcgcccaacaatttattgagcgtggtatattatatctacatatccaatcacaattggccgatctcacacaaaatttactaaaaggtatccaaatagagtcagatagaaaagcattttttatcagtatactgggttgccggggagggataggcacgacattactcagttaccaactggcgcatgtgatcacccaaataaaaaaatcgcctaccttgttattacaaggcaatcaaggctcgcaagatctcgacttgatcactgaaaaaaaaatgggcgaagatattactggttaccagaaaaattttgatcttatgcgaggaaacgaaagaaaactcagtgaagttaatgagcataacaataaaaaacataactttattattttcgatcaaccaattcataatgcacggaaagaaaaaacactcgattatatctctaactcaaattgcatcattctgcttattgaccatagtatgatgtccgttcgtgtagcgaaagagtttattgatactctggaaaggttcaaaagagataatagacaagccattagactatttatttgccttaacgaaaacaggccaataacaaaagatatgttgacgacttctgatatccaatcattattgggccattccattgataccgcgataccttatatcaacaatgcgaagaattcactaaatagccctgactattttggtagaaagaaaaccaaggttgttgaactggcaaaacaatctttaggtataaatataaatttatcctctcataccaatatgtggattagggaaaaactcaataaattatttaaataaatgaggttattatgattgtccctttaaaaatacaagagttaatgcgcgaaagaatgttagccaatattgacattaataaagttgaactcctggttgatgatcgtaacaaactcatcggattgctctctcaaacattcgatgatttatttaataataatgaatataacttaacgactcaagcacaaaaatatattattgaaatgatagctgatgaaataaccggctttggcccattaagagaacttatggaggatgattccattagtgatattatggtcaacggcccagaaaggatattcatcgaaagatatggcctgttaaaattaactgaccggcggtttgttaataatactcaactcaccgatatcgcaaagcgtttaatgcaaaaggttaatcgacgcattgatgaaggccgcccattagcagatgcccgtttaatcgatggtagccgaataaacgtcgcgatcagccccattgctttagatggtaccaccctttctatccgtaaattcagtaaaaataaacggagattagaagatttggtcgatatgggagccatgagtagtgatatggcaaatttcctaattattgctgccagttgccgcgtaaatattattatttccggaggtacaggctcagggaaaaccacgctattgaatgcgctttcaaaatatatttcagaagatgagcgggtgataacactcgaagatgctgcggaactgaatctggagcagccccatgtggtcaggatggaaacccgtctggcggggctggagaatactggccagataaccatgcgcgatctggtgattaactccctgcgtatgcgccctgacaggatcattattggtgagtgccggggtgaggaaacctttgaaatgttacaggcgatgaacactggccataacggttcaatgtccaccctacatgccaatactccccgtgatgctgttgcccgtttagaaagcatgattatgatggggccggttaatatgcctctcattaccatccgccgtaatattgcatctgcaattaatcttattgtccaagtctcacgtatgaatgatggctcgcgaaaaattcgcaatatcagcgagatcatgggaatggaaggtgaacatgttgttttgcaagatatatttactttccaacccgccagtactcgtgatgatcaagggcgtattcagggtgagtttatcaaccatgggctatttaatcggtcatcagtcagaataaacgccgatatccacaatctggccaatgagttaaacagtgttttctctacggtgagcaaatgatttattacgtcgtcgcgttatccggtattttattactggtgctgaataaccttaagtggatgaaaataaagcgctcaataagcaacactaaaaagagcaaagccaaaagtacatcttctattactatactgataaaaaaaatatttttcgaatggattgattacgtatcaacccacagtaaaagcacacctcatatattattaccaatatgttcattggtgatagtctattatataaacagcacttggattaatgttaattactcttttgtttttattatcaacatcatttttattatcgttttacaactaaaatatgctcgttcaaaacattatttattatttaagcaagatttccctgaagtactattaatgattaatatggcagcaagcagcggtgccagtatcaatcaagtattggaacgctgtgggaaagagattagaggccccttgggacaagaattagggttgatctgtcggcgattaaatcttggcgaaacccctgaaaccgttttttatgatgcgtatgagcggttccattatccagaattttatttcttagtgacaataatactgcttaatattcagcaaggaggccaattaaaagaactgattacccgattaagccagataataacaaagaaaaaaacaaccgaacaaaagaaggccgtcatgacggctcaaataagaatgtcggttaatattatttctatcatgccaatgttattttcttttttactttatctactcgaccccacgacgatagagtttgtatggcaacatcccacaggtagatttattatctattatattattatcagtgaggttattggcatattgattatcagaaaaatgctaggtaaatccctatgagaattattttcttcacgttattaatactattgggtttgattatcatattaaaagtcaactcacgctcaagaagaatatcagtttataataaaataaattcgcgtgaaaacaaaagcaaagaggcaaataatgatacaaaagataaaccgactgtactgtctgattttataaaactccctgtttttttatctaacattttatatctaaaggttttgattgttatttttatattatccatccttacaatattggctatttttaatgtagtgaatatcaatcaaaaaacactactcactattgggctactctctattatctccaccttatatttgccaaaaatgataattaaaaatgcactcactaaaagaacaaataatttattgaaatctttacctttctttattgatattacagcggcatgtgttcaatctggcatgacaatagagaattcattaaattataccacacaaaaattccaaacaataaataccgacctatgcttgattatgtcaaaagtgaccaagcgtgctgaaataaatggtttagaaaatgcgattaaagaacttcaatattactcaccagcaatagaaatgaaaatgttttgcagcacactgcaatacagtattagttttggctcaacggtgtacgaacaactgactcacttatcacaagatatgagagaaatgcagctgctgatgacagaagagagcatcagtaaattatccacaaaactaacactgccattatttttatttattttgatccctttcgtcttattggttatctcaccgagtattctggagctacttaactatgttaaaaatatttaatactattattatcatcccagtgatgatttttctgttaagcggttgtttgagccaacagggtttaagctcacaaggtttaagcacaaaagaattttcttatcgtgaaagtattttaattaaagccaataatcaaattggtttgattaaactctatcgcgaatcactaaaaaacaaagaagacgaatcaatcagagtgaaattagcaaatgcctattacctctccggtgatagccattcttctttatattatttgcaacctatttcccataaacctaacgtatctatctatcttttacagataaaaaatttaattaacgagggtgataattctggtgcgactacagtactgcacaggttattatctattgccccccataatcctgaagcacataacctaaaaggtattattctggctaaccgtggtgatacagcaggggcgcgtaccgctattgttcaatcgcaggctctgtttatccaagaggacattgcaagaaataatattgcagtcatttcaatgttggataaccgctatgaagatgcagtaaagatattactaccagactatctttccggtaaaagaaacaacttaatattacataatctggtatttgcattgattaaaatgggtgacactcgctacgcaaagaacattattgaagcagaacggttatctgataatgctgacgagttagtattagcgctgagtcaggttgattcattccctcaggaacaatccgtcattagggaaaaatgatgagagatacaatattacgtttattgccggcgaatagaggttctattgctgttgaatttacgttaatttttatcctttttatctttatgctgctattggttgctgaaacctctcgcttgttttatacctcggctaatcttgatttcgcattatctgaagcagctaaaaccgctaaaaatagggacgacgagaacgtactctcttatcaacaactttttgagcataattttaatcgacaagttactgttctgggatcattgattaataccgcgccctccgcagaacttacggttaattttagtcacagtgttgctgatcttattaatggcaatagtgaagaaaataatcacactctaccactcgcccactatcaggttagattacattaccaaccgatatttttacctttccctcaagcatgggtaaatacgttattgtccagggaggtgatttttgttcaggaaaaataatacgttaatcaataatcaaggtggtgcaattattgttgaatttgcatttgtgacttttattattgttctatttataaaactgctgattgccatcgctgaatatcagtcgatttccggtaagttagatcgtctttcatattcagccgcgggtatcattcgtgaaagggggcggttatatccgcatgatcctgaattgaatcaacagcaagttgatcaactcagagatcttgttcagcgtgcgttactgaactcgggtgtacctgctgataacctcaggatgcgggtagagacattacattttaaccccatcgagccaccaggttctcgtcagcaacagattgatgagcataagagcctgtcattcagtactggcgattgctccccggttcagccactccgtgggttagttgcgctgtcaccattaagccaaagtgaacgctgggtgccgctctaccaggtcacaatatgcctgcccccccctcagagataccgtgacctgattagtgtcagccccttgccaacattgaaatcatcggccatcacaatcgggcgctaaacagcctacgaataaaggttatatatgcagaaaaaaacaatgataactttcatactagagaagtgtgagttttttattaaaaatagacagggagccattctattgtcttttatggcgttaatccctgtttttattgggttgatatttttgtcgtttgaattttctcactttatccaaaagagagctaaactctctgatgcccttgaacaagcatctttagccttatcgacagaaaataattataggaatgatagagccagtaataatagaaacaattatctggttacatcgtacgcacaatcttatttaccgtcagagcgtttttcgcaaccaagggtagtcaatacctacaatgagagtttaggttacactgaatataatgccagtctgcaaatgaattatcagttagcattattaaactcttacttaaaacaaaccccctcgccgacgtgggatgttaacgaaaatggggccgccagaaagtatttatcatcaatagccgaacctatagatgtcgtgtttgtcaccgatttttccggatcgatggatttacctttcggggatattgagcgaaataacagaataactaaacttgatgaactaaaagcgatttttgtaaaattaaataaccgaatattttcaaacgatggcattaacaccattgggtttgttcccttctcatggggtacaaaaagaatatctgccaatggacaggtatcatctacttattgccactttccctattctcctaaaaaaatagatagaaatggtcattatctccaacgttataccgcctcaaacttaaagaatattcctggtttggacaatctcagtgggatagataatctcgcttacggtcaattagatgaagataaacaccacgctatccttagcgaaatagaaaaaaaacatagagacaatgaaatacctactaaaaccagagatcaggctaaaaattttcttgataaggcatataaagtaaatcaaatttcgactatcactaaaattgtggaagaacatattgattataaagaaacaataaactcaattgaccgaaatggtgaaacgattgatataccaatggatgacatattagatccatttttctgtctaaaagagaccaacgcaaaatcacttaactttgatcctaattcaaaaggagatataaacgaaatcctcaatatgaaggctgaagggggaacattagccagctcaggaatattggtgggtaacaaaatgctcactgaaagccaaaataacaataaactgatgattatcctgtctgatggtgatgataatacgcaaaaaatgagttctccacacgatcagaaagcgggcatcatcaatatcacgcaaaaattgattaccgagggtatgtgtcagaaaattaaagataatggcataaaaatggtttttatcgggattggctacgttcccgataataatattatcgattgggaaaaagactgtgtagggacgggtaatttttatctggcaaaaaatgcccacgaattagaaattagtatcgagcgagcactggttgttgatgatgaagtggggagaaatatccctaaaagctgaaattgacttaaaaatcgatattgacctaaaaactgaaatttcctcaaaaaccaaagttgatgcaagcgcggtaacagtaaccgcgcttgcaaaaaattattttgcgccgctggaccctgcttccatacccactaacccaactttgagatagcctgatttacgtagcgcatccatcacgctcatcaaggtttcataatccaccactttatctgcctggaagaaaatcgtggtttctttattggattgggtcactttgtccagtgccgcggctaatgtttcacggtcaactggctggtcgccgacataaagctggttatccgctttaaccgtcaagaataccggtttctctggccgcggctgcggtactgccgaagatgcaggtagatccactttgatatctaccgttgccaacggcgcggcgaccataaagataatcagcagcaccaacatgacatcaataaacggcgtcacgttaatttcgtgtaattctccactctcgtcgagggaatcattcattcgcattgccataaatcaccctgctcgtaattgatgaggatggcgaggggactttacttcggcgctactggccaaatccaaatcacggctcaacagcagtaacacttgtgccgcgacatcacccacttgagcgcgataatttccgatctggcgagcaaagatattataaataacgaccgctgggatcgcagccaccagccctaacgccgttgccaataacgcttcggcaatccctggagcgacaaccgccagattggtggtctgtgagtgggcaatgccgataaagctgttcatgatgccccaaaccgtaccaaacaaaccgacaaagggggaaattgcgccgattgttgccaggaagccattacctttgcccatttggcggccaatggcggctacccggcgctccaaacggaaagcagtacgttctttaatgccattattgtcatttgactctatcgacaacaggcgctcgttcagtgcttcatgcagtaacaaactgcttacgctgccttgaccaaaatcttctgctcgctccgaagcggtatcaagatcggtcacggccccaatcacttcatgctcttggcgcaaccgacgacgagcgcggaacaattcagtccctttagagaacagaatggtccaagtgacgatagaagccagcaccagaccaatcatgacgcctttaacaaccacgtccgcattctgatacataccccagacagataaatccatcgccagcttttgtggtactggagccgtaacgggctgaaccataggggccggtattgattctgaggttaatgctgatgctgatgttaatactgactctggtgttgattccggtattgcagcaaccgaggtaatttctggtgcaggtaacggggttgacgttgccgctgtgggtgcggtaaccgtagccgcaaccgcactgccgttgcctggtgcggcttgtgcatggcccgctaaacctgtagccagtaataataccatcacgcctttcatcacccggccttgcactcgtgatatctctttactctctttgccagctattttcacgctgcgcctccacccaatatgcatgtcaatttaaggacaaaatcagctcttgatcatatcaaacaaacagcggattgatagtaattatcattagtatttggcaagatttttttgagcgcaagaaagaatgaagtcaatatcgacggtgcccccacgccgaactaacggttgttgttagctgttgcttctcagtaaccgcccatccataaggaagaagtgattgattgaatagaagaacgcttaagtcagtggccgccctcttaaggcgctatttattaataaatgttctattttgtcatttacacagaatttttctgccgcaaaacagtagaaaacagcgagtcgctctctttagtttttttcatggtgaaagcgactcccagacaacaatcatcatgctaacgtaggaatacatccccaaaatgaatgctggctggcgattgactggcttggcttatacgaaggtgacaacacaattatggcagtgaataaagcaatcccagaaaaactggaaacagccttagtcagcgcagggcgaagtaaaaaatttactcaaggctcagtgaataccgtgatccaacgagcatcatctctggttttcgaatctgtaaaagcgaaaaaacatgccacgatcaatcggggcaatggtgagttgttctatggccgcagggggacattaacccacttctctttgcaagaggcaatgacggagctggagggcggcgcaggttgcgtgctttatccttgtggcgctgccgccatcagtaatgcgattttatcgtttgtcgccacgggcgatcatgtgctgatgaccggttcagcttatgagcccgcccaaagtttctgcgataagattttatcgcgcatgaatatcacgacgacctattttgatcccatgataggtgctgggattgcttcactgattaccccgaaaaccaaggtgatatttcttgagtcacccggctccatcaccatggaagtgcaggatattcctgcgatggtggcggccatccgggcggtggctccggatgtcgttatcatgatggacaacacctgggccgcaggtgtgttatttaaagcactggattttgatatcgatatctctattcaatccggcactaaatacattattggtcactctgatgccatgctgggcattgcggttgccaatgcccgctgctgggaacaactgcgtgaagactcttatttgatgggccagatggtcgatgctgatactgcctatcttgccagccggggcttacgcacgttaagcgtccggttaaaacaacatgagaaaaacagcattgaaatcgctaactggttggcagagcgcccggaagtggcggtggtttatcatcccgcactgccaggctgcaagggccatgaattctacaagcgggattttaatggctgcaatggtttgttttctttcgaattaaaagaagaattaacccagcaacaactggagaattacctggatcactttacccatttcagcatggcgttttcatggggtggttttgaatcgctgatattaggttatcagccgaaggatattcgtgcgatccgcaaatatgacgcggaaggcatcaaaggaacattattccgtctgcatattggccttgagaatgtgcaagatttgcaagacgatctggccgcaggatttgagcgaattcaagccgtaaaatagaggcctccactccgttaatgcgctatcaattcttggcgcattaacgctcccttacataaaagaaccaacgataggtttatatcgcctgccaaattgagttattggggataagatcaacgtgattttacctcattaaagatatactgatacccaccaacgatatcctcacacattaggcaaacaggaaaagaaatggatgtattacgtgaaatccttcatgccctctggcaacaggattttagtaaactggctgacccaaatgttatttgggtgatttacggtatcctttttaccaccctatttttagaaaacggtttgcttcccgcctcttttctccccggagatagcttgttgctcttggccggtgcgttgatagccaaaggggtgatgggtttcttgcccacgctgatcattctgactaccgccgccagtttaggctgttggttaagttatctacaaggccgctggttgggtgatacctcggtggtgaaacggtggttgttacagctccctcttcagtaccgtcagcgcgcccataccctgtttgttcgccacggtttagccgccttattggtgggccgttttctggcttttgtccggacgttactgccaacactggcgggtatttctggcctgaacagcatacgttttcagttatttaattggctaagcggcctgctgtgggttggcagcgtcgtgggtttgggttttgccctcagccatattccgttggttaaacagtatgaaaatcaggtgatgacggcactgatgattttacccattgttctgttattggccggtttagtcggcacactgattttggtatggtgcaaacgtaagagcacgaccgaatagcgtaaataggcaccatccaggtgaataaaacggcatctaatacgccgtttctatgaagccttggttacagctatcgcccctcggccaagggtcaattaatacgctgtttggcaacaccttcactcggcgtatgaccaaagtagcgtttaaactcacggctgaattgtgaggcactctcgtaacccaccttgatcgccgcagtgctggctttcagcccatcatgtaacatcatcatgcgcgcccgatgcaatcggtaagacttcagatattgcagtggagaggtgttggttaccgctttaaagttgtggtggaatgctgaaacactcatattcacctccgccgctaattgctcgacactgaggttatcggcaaaatgattttcgatgcgccgcaatgttttggtgatctggttaaagtgcccatggcggttaactaacgcctgcaaggccccaccgcatgacccacacaagacgtagtagagaatttctcgcacaatttgcggaccaaggacgcgggcatcacgggcaatggacatcacatccaagagccgttctgttgcacacagcatctcttcagtcagaggggcagagttcacacccgaggtattgcccggcggtttttccagctcgtcatcccccatggtcatcatcaaatcttgtaacatctggctgtctacttgaatggaaatcccggccaatggtatttcagggctggcaaacgtttcacactcaaacggcagcggaacactcaggatgaggtagtttttgggatcatactgaaacactttactgcccagataacccactttgtgtccctgaaatataatcaccacactgggggtgtacattaccggtgttcgcggttgatgcactgtagagtacaaaattttcaccccggataccgttgagggggttaaaccatcaccttgagccagacgcgcaattttatctgccatttgtgcttgaatatcaatcacatcaaccattacgtcctcgtccgctttttgtatgactttgaataatagagaccatgctatttattgccccaagtgatcgattaccaaaaatcctattgttcaaaacaatctgacatagattgtgtcttatttgctgggttttctacagtgatctggagaaataggcaagagcaaggcagaaatgtgcattgaggtctgttcttaagttgccgacaatggttaccaatgaaattaagcacatcgttattatacttatactgacagtggctaaatcgtactcatattgacgaaaaaagtgctccaggcacagtgatgtggttacggataaatactcactgcatcaccttatcgctaagcagcaacacctgtttttttactgttcatcccataagctggaagagaaatcatgcaaaattttacccttcatacccccactaaagtgctgttcggtaccggtcaaatcgcgcaattgactcaagaaatcccggcggatgcccggatattgattacctacggcggcggcagcattaaacaaaatggcgtgctggatcaagttcatcaagcattgaaaggctttgattttctggaatttggtggcatagaacccaatccaacctatgaaacgctgatgaaagctgtcgagctatgccggactgaaggtatcaacttcctactggccgttggcggagggtcagtattggatggcaccaaatttattgctgcagcggtcaattatccacaagatccatggcacattctggaaaccacagggcgcgatattactgaagcgctgccaatgggctcggttctgaccttaccggcaacaggttctgaggctaataatggcgcagttatcagccgccgtagcaccggagataaacagcacttcttctcaccccatgtccagcccctgtttgccgtgctggatccggtggtcacttataccttgccaccacgccaggtggctaacggtgtggtcgatgcttttgttcataccattgagcaatatctgacctatcccgtggatgccaaagtacaggatcgctttgctgaagggctattgttgaccctgattgaagaaggcccgaaagcactaaaagatccggaaaactacaatgtccgcgccaatattatgtggagcgccaccatggccttgaatggcctgattggtgccggtgtaccacaggattgggccacccatatgttgggccacgaactgactgcgcgccatggtttggatcatgcacaaacattggcggtagtgttaccggccctgctggttgcgaagaagcagcaaaagcgcgccaaactgctgcaatatgcagagcgtgtctggggattgcgtgagggcagtgaagatcagcgcattgatgcggcgattgaagccacccgtcacttcttcgaaagcctgggtgtagcgactcgtttatccgcctacaaactggacggcagttctattccggatctgattaaaaagctggaagagcacgggatgaccaaactgggtgagcacagtgacatcaccttagctgacagcaagcgtatctatgaagcggcggtataaccgttttatgtaagatttaacgggatttagcctgcatttatctcgtaccaaaactggcggcattaccgcatgtcatgctgccagtcctcctgtttatacccattagacttcaggctacataggtgttggtggcgttctctcacttcgtcgctgcctgccgacaacccgaatgattttgggtatattttctttttcgcctgcgattcacttttttcgcctgcgattaactgggcgatatgatgattagctgcccataataatattgtctgcatagagcaacattattcacacataaccctactatcctcatgtaacaggacttaataattagcaaggtcataaataaaatgataacgactaaacttacgttatcagcaacgggctaatacagcccaatcagtaagccaaggagatcaacatgacaatgcaaccccttatcaagttgcacgatgggcgcttgatgccacaactcggcctcggcgtttggcaggcaagtatccaagaaacagagcttgcggtcagtaaggcgctggaagtcggttaccgctcaattgataccgccgctatttataaaaatgaagaaggtgtgggcaaggcgctgaaagcggcggctgttgcccgtgatgaactgtttatcaccacaaaactgtggaacgatgatcaacataatcctcagcaagccctggaaaccagcctgcaaaagctccaactggattatatagatctctacctgatccattggccagacccgaaacaagaccattatgtcagtgcctggcgtgaactggtcacactaaaagagcaaggtttgatccgcagtatcggcgtgtgtaacttccatattcctcatctgcaacggttgattgatgagacgggtatcgcccctaccgtcaatcagattgaactgcatccgttgctgcaacaacgtcagctccatgcctggaatgccacccatcatattgcaaccgagtcttggagcccgttagcacaaggtggcaaaggcgtttttgatcaagagattatccgcaagctcgctcagcaatataataaaacgcctgcacaaatcgtgatccgttggcatctggacagtgggctgattgttatccccaaatctgtcacaccagcacgtatcagagaaaactttgaggtctttgattttaagctacaaaaagaggagttgctggcaattaccaaactggattgcggtaaacggctggggccagacccggaagttttcggatccgaccgctgatttcaggccagcaatacccccttaatgctgtctgtttttccctctggatccggcagatggcttattgaccgcagctttatttacgcccgttttacccgctgattttttggttgcgagcatactgtgggctgcagaagtactttggtttgcagacgtactttggtttgcagaagtactttgatttgcagaagtactgtgcgctgaagaagtgccattagccaccgtcggagccttcttgccagcagaggctgcgggtgctctattactcggctggcgctggcgggtgatcgatgtatgcttggtcagtgccggtgtgtggtggcgcagagcacggcgtgcctcacgctgctcttccaaggtcggagccggcaccaggcattcacgacgagcgccaatcaaatgttgcagccccatatcttcaagcgcactgcggagcatcggccagttagccggatcatgataacgcagcaatgctttatgtaatcgccgttgacgatcccctttgggaaccaccacctcttcacttttataatccactttcgccaacgggttcttaccggtgtaatacatggtggtcgagttagccaacggtgacggatagaagttttgcacctgatccaatcggaagcggtttttcttcagccacagcgccaggttcaccatatctttatcttcagtacccggatgtgcggagatgaaataagggatcaaatactgctctttaccggcctgtttcgagtaagtatcaaacagttctttgaagcgctgatagctgcccatacccggtttcatcattttagaaagcggcccttcctcagtatgctctggcgcgattttcaaataaccgcccacatggtggctggccaactctttgatataacgcggatcttctactgccaaatcgtagcgaacgccggaggcgatcaggatctttttgatccctttcaaatcacgggctcgacggtacaaagagatcgtcggttgatggttggtatccatgtgcgggcaaatctcaggatacacacaagacgcccggcggcaggtttgttcagcccgaggggactggcagcgcagcatatacatattcgcggtaggcccgccaagatcagaaataataccggtaaaaccagggactttatcgcgaatctcttcgatttcacgaataatagagtcttcagagcgactctgaataatgcgcccttcatgctccgtaatagagcagaaggagcaaccgccataacagccgcgcatgatattgatcgaaaaacgaatcatgtcataggccgggatcggtgattttccgtaggacgggtgcgggacgcgctgataaggcagtgcaaatacactgtccatctcttcggtactcagcgggatcgccggtgggttaatccaaatatagcgatcgccatgtttctgcatcaacgcccgcgcacaaccaggattagtttcatgatgcaaaatccgcgaggtatgggcatacaatactttgtccgccttcactttttcatatgaaggcagtaaaacgtaggtcttttcccatggcttcggtttggccgcacgcacggttattggtttggcctccggtatcgatatgtcatcggtcgcacacggcagatcttcaccgtaaggattgggaatggcttcaatacggcccggtttatccagacgggtagaatccaccccgctccagcccggcaagggcgttttacgcatcacaacggtgttacggacatcctgaatatccgtaattttctcacccgcagccaaacggtgcgccacttccaccaatggccgttcgccattgccatacaccagcatgtccgctttagcatctacgatcaccgagcggcgcacagtatcagaccaatagtcatagtgagcaatacggcgcaggctggcctcgatgccgcccagtaataccggcacatggctataggcttctttgcagcgttggctatacaccaatgtcgcgcgatctggccgcttaccactctggttatccggcgtataagcatcatcgtggcgcagttttcggtcagccgtatagcggttgatcatcgaatccatattgcccgccgtgacaccaaagaacagattcggctctcccagacgcataaaatcatgtttattcgtccaatctggctgagcaataatcccgacccgaaatccctgagcttccagcatacggccaacgatggccataccaaagcttgggtggtcaacataggcatcaccagtgatgacaatgatatcgcaactgtcccaacccaatatgtccatttcctcccgtgacataggtaagaatggcgcggtgccatagcattcagcccaataaggctgataagaaaacaggtcacgctctggttggatcaagctgatactcatggcaacactctttaatagggggaaagttgaggtggttcgggttaagaaatcatcaccggccggcgattatacgcagttatccatgtgaagaggaaggatatatcttttgatgacatggatggctttgaaattagttgttggccataaaagtacatatcagtaaacctgcgaagcaggcaagcgagacatgcgtaagcgcagggtcctaatggggccacgcttatggccccattggcggttgaagctacggagattagctgagctaagccataacaaccgaaccgatcatcacgtcaccaaaacgtgatcaaagcgtcggtgctgccaccgtcactaactgccccgccgaaccacgatcagccatttccagcgtctgactgtagaacaagaacgggaattgcggtgatgaaacctgattgaaatacacccacaattcaaccgtaccatccacccaaaccgtatccttccaaccacgatcttcggccattgccgccgcaccattcacacttttcaccaggaaagaaacgccctgaatatgaaatgcttgtggcatatcagcatgtattatccaacgctcccatgtcccctgctgagcctgcacatctactcggttcatatcccagatagcgccgttaattcccggtagattatcccccagttggaattcacgggaacggatcacactgccttcaataatctgatctgccaataaacgcataggcaaattatccgtcaccaatggcaataaccccgttggttttaatgtcagcaccagggtagaaatcaaaatacttgatggctcaaataacccacgcaggcgatccataataccggcggattcaccagcagtgatcgagacttcattgccctgtgacatatcaatcaccacttcacgccgttcacctggtgcaagagaaagttgctgtaccgccactggcgcaggtagaaaaccctgatcgctggcaacaacatacagaggacggccatcactgagttgcagggtgtagcggcgggcgttagacgcattcaataaacgtaaacgtacccacccacgagagacttcaacaaatgggctttgcgccccgttaaccaataatgtgtccccgacaaacccccctttggcaggcgggttatattccggcacaccaaaattatccagccgtttatcttgaataataagagggaaatcatcaacgccatagtgacttggcagcggcatcgctttactgaccgcatcttccaccagccacatccccgctagcccgttatagacatggggagccattcggttgggggtattggcatgataccagcagtttgccgccggctgacgtaccggcaatacgggtgaccaatcctctccggggcggatcatccgggcctctccgcccatcagcgtcccagggacttgtaacccactgatcgtcatcgataccggctcagtcaaccggttgctgtagatgagcttaacgtcatcaccattaaaaactctgaccgtcggccccagatacatgccgttaattccccacactgcggctttcttattgccactaaatgcccagtgcgcgcgctgcaaggttaaaaaaagcggttggccgcggcgagattctaataaggggggcaccggtaactgaggttgctgagtactactagcctgtgccctcaatggcagtgagccagcaccaagcgctaagcccgcagcctgaatgaactggcgacgactgagtgacatatcttctccgtgaaaaccacaatcaaacctactgcaaaattttgcctgactgcgaataacgctgaaggacggcaaaacgctcacgaccagagtcgcttaaatcaacatctaaaatttgtggcgataaatataaccaccgcgcggggccgcgatagcctgcaccgcaaaaacaaatacattattttttagcaacggactgttgagccacttcggcatctaactgctcaattttagccagcatcaaattgcggcaatgctcagacagctcacgaacgcgctctttagtgtacccagaggtgtcaatgggcggtaacatctcaataatcactttaccgttcgaccaacgatttaacttgataccattagtgctagaaacgcagatcggtacgataggaacacctgcagcaatcgccgcatggaacgcgccagtcttaaacggcaataaaccacggccacggctgcgtgtgccttctgggaacatccaaatagagatgtttcttttttgcacctgttcaaccacctgagcaatggtgctgtgagccttggcacggttgtcacgatcaataagcaggttacccgtcaaccaatagagcgggccaaataagggcacccacagcaggctctttttgcccacggtcacggtaccgggctgaaccacattcgacatggtaaccatatcgtaattattttggtggttagcaatataaatacagttaccgtatttagccgcttctgcgggaatacgctgctcaatcgtaatgccaaacaacacggacatccggccaaacagatgcgaaaatgttgccacatggcgaggatttcgcgggctgaacaggcaataaatcgaaccaaacacacacactagaaaacaatataaaacagccagaaccgtgcgcaaaattaatagcataaccgcctcttaaatactcacccttaaatagacaaccgacgctagtataacggtttactcgcaaaatactgtttacttgcaaaatacgacttacttttaaaatacgacttacttttaaaatacagtgcagaacccttgccaccgctcggttacacgacagtgcgcgcaaattatacctgccgtatgccatattaacagggtcatgtttgacgaacgcctcaatcaccaccacagccatttccgccatggtggtggctggtttccttatttttactcttcgctctcggtggctattgcccgtggcggtgcatcgacatcaatccgatcaatgcgttgtaaaccacgtggtaatggcgaacctttacgacctcgctcagcacggaatttttgcaaatcttcaggccgtagcgtgagtttacgtttaccaaaatgaagggtaatcgaggtttgcggaggcaggacaaacagccatgctaagcgatcttcacctgccgccgcttgtgctgcggggatagagacaattttgttgcctttaccttttgaaagctcagggagatcagcgaccgggaacatcaacatccggccaaccgcagtgatggatagcagcatgtcatccgggccataaatttccagtggcggcaagactttggcattttctggcaatgtgatcatcgtcttgccagcgcggttcttggcgaccaaatcattaaaagtacagacaaagccataacctgcatctgatgccatcagtaatttctgcgaatccggtgccattaagacatgttcaatggtcgcccccggcggtggcgtcagtttgccggtcagcggctccccttggccacgggcagaaggcagcgtgagcggatctaatgcgtaactgcgccccgttgagtcgataaataccaccggttgattgctcatgccccgcgcggcggcacggaagctgtcacccgctttatagcttaatccgcttggatcgatatcatggcctttcgcactacgaacccagcccatttcagacaacacaatggttaccggttcagaaggcacaatatcatgctcgctcatggctttggcttcaccacgttcagttagcggtgaacggcggtcatcaccataagcagcagcatcggcttgaatttctttcttgatcagggtgttaagtttacgttcagacgccagcagtgcctgtagctgatcgcgttctttcgctaactcatcctgctcaccccggattttcacctcttccagcttggctaagtggcggagtttcagttcgaggatcgcctcagcctgcgtttccgaaatggaaaaacgctgcatcagtagcggtttaggatcatcttcggtgcggatgatatgaataacttcatcaatattcaggaaggcaattaataaaccttctaaaatatgcaggcgcttcaataccttttccaagcggaaattcaggcgattgcgcacagtttggcggcggaagaccaaccactcagtcaggatctctaacaaccctttgactgatgggcggttatccaaaccgatcatattcatattgatgcgataacttctttccaaatcagtcgtggcgaacaggtggctcatcacttgatccagatcgacccgattggtgcgcggaacaattaccaggcgagtagggttctcatggtcagattcatcacgtaaatcttcaaccataggcaatttcttagcgcgcatctggttggcaatctgttccagtactttcgcgccggaaacctgatgtggtaacgccgtgatcacggcgctgccatcttcttttttccacaccgccctcatacggacggagccacgaccattctggtaaattttgcgaatatcatcacgcggagtgataatttctgcttcagtcgggaaatccggcccttgcacaaactctagcaactcgtcgagcgacgtcgtgggtttatcgatcagcgccagcactgcctgcgcaatttcgcgcacgttgtgtggcgggatatccgtcgccatgcccacagcaataccggttgtaccgttcagcaagatatttggcaggcgcgcagggagcattttcggctcctgcatggtgccatcaaagtttggcacccaatctaccgtgccttgggccagctcacccaataacacttccgcatatttggataaacgagattcggtataacgcatcgccgcaaaggatttaggatcatccggtgcaccccagttcccctgcccatcaaccagtgggtagcgataagaaaaaggctgtgccatcaataccatcgcttcatagcaagcactgtcgccgtgcggatgatatttacccagcacgtcacccacggtacgggctgattttttgaatttagcgctgttattcaaccccagttcggacatcgcgtagacaatgcgacgctgtaccggctttaaaccatcgccgataaacggcaacgcccgatccatgatgacgtacatggaatagttcagataggcgttttcagtaaaggtgtgcagcggtaggcgttctgcaccgtcatgagtcaagtcactcattactcaattatcctcagactctggaatgacgatcactggcgtcagcggatcggcaccgcaagttcattgtcaatttctgcccgcgatagtacctcatctacagggttactgtcacagttcacaatcaatctcaatcgtttcgcgttttattgcttgcccggtgctttattgatctttgagcaacagtgttatgcattattgtctatttttctctggtcagttaaccattagcatactcagcattccggggagcccaacaaaaatgctctcaggttccccttttgctttagaaggtcgatatcaatgagtaacgtactaattattaatgcaatgaaagagtttgcccattctaaaggggctcttaatcttactctcactaacgtagctgccgatttcctgcgtgagagcggccaccaggtgaaaatcaccacggttgatcagggctatgatattgaaagtgaaattgaaaattacctgtgggcggatactatcatttatcaaatgcccgcctggtggatgggtgagccttggattttgaaaaagtatattgatgaggtctttaccgatggccatggccgcctgtatcagagcgatggtcgtacacgttccgatgccactaaaggttacggttctggcggtttgattcagggcaaaacctatatgctatccgtgacctggaacgcaccgcgtgaggcctttactgatccggagcagttcttccacggcgtgggagtcgatggggtttatctgccgttccacaaggcaaaccaattccttggcatgaaaccattaccgacatttatgtgtaacgatgtgattaaacagccggatattgaaggggatattgcccgctatcgtcagcacttagccgaaaacgttaacagctaagcggttcggccctcctctctctggggagggccgttttatacgttacccctccctcatttatattcttagccagtgactcccctgtaacttaatctgttcactaacataatcaagaaaacaggtaatgcgcgcagcaagctgagtattacggtaataaacggcgttgatcggttgccaagtctctagaatttgatcagccagaacctcgactaaacgcccagctaattgatcctcgcgggtcatgaaatcagagagttcggcaatcccttcgccctgtaaagccagtaaacgcagagtctcaccgctggaagccgccaagttggggataattgacgaacgcccgccgggtaaatggggtaatgaccactgattaagaaattcgggctgagtaaagcccagcaggctgtgatctgccagtgcctcaatggtgtgaggcgtaccgtgacgttgtaggtagttagggctggcaagcagacgcacccggctggcaccaagcagccgggcatggatcgtcgaatccctcaacgcaccgatacggatagcaatgtcagtgcgctgctcaagcagatcgatattgagatcgtcggtattcaattccaacgtgatttgcggatacaacgcacggaaaccggtgatcatcggcacaatgacatgttgcataaaaggagctgccgcattaactcgtaaccggccagcaggcttcaaccgcctcagggcaatttgctcttcagcatcatcgactgcgccgataatctgccgcgcatgactgaggaacagcgccccctcttctgtcagctccagacgccgagtcgtacggcgtagcaacgttgtcgccagcttctgctctagccgactcaatgcccggctaatccccgatgtcgtttggctgcgctgctctgccgcagccgtgatagagccgcagtccactaccgaggtaaatgcctgcaactcttccaacgtgactttcatcgatcagacctcgatctcagcagtatcccctttctcttgtagccagttgcggcgatcttccgagcgtttctttgccaacaacatatccataacggccagagtgtgatcaatatcatcatcactgatggtcaattgcaccagacggcgggtattgggatcaagggtggtttcacgcaattgtaatgggttcatttcacccaaccctttgaaacgctgaacgttaggtttaccccgtttgcgtttcagttgctcaagcacaccggctttctcttcttcatccagcgcgtaaaagacctctttgcctagatcgatacggtacaacggcggcatcgccacatacacatgaccattgcggaccagtgcccggaagtgacgcacaaacagtgcgcacagcaacgtggcaatatgcaggccatcggagtccgcatccgccagaatgcacactttaccgtaacgtaactggcttaagtcttcgctatcaggatcaataccgatcgccacggaaatatcgtgaacttcctgcgaggccaggacttcatcagaggaaacctcccaagtgttcaagatcttgcctttcaacggcatgatcgcctgatattcccggtcgcgggcttgtttcgcggaaccgccggcggaatccccttccaccaaaaatagctctgtgaggttcaagtcctgcgaagtacaatctgccagtttgccaggcagtgccgggccactggtcagttttttacgcaccactttttttgctgcacgcatacgacgctgagcgctggaaatcgccagttcagccagttgttctgcggcctgcacattctggtttaaccataagctgaaggcatctttgacaacaccggagacaaaggccgcacattgacgtgaggagagccgctctttcgtctgacccgcgaactgtggatcctgcatttttaccgataacacataagcacagcgttcccagatatcatctgccgagagcttgactccgcgaggcaagatattgcggtattcacagaaatcgcgcatggcatccagcaacccctgacgcaagccattaacgtgggtaccgccctgcatggttgggatcaggttaacgtagctttcagtcagcagttcgccgccttctggcaaccacagtaatgcccagtcgatagcttctgtatcacccgcaaaagaccccacaaagggtgcttctggcagagtaataaagccgttaaccgcttccatcagataatcggttagaccatcggcataacaccaacgctgttctgtgttgttgacctgatctttaaaaacgatctcgacgcctggacacaataccgctttggctttcagtaaatgggatagacgagaaaccgaaaaacgcgggctatcaaagaaagagacgtccggccagaaatgcacactggtgccagtattgcgcttaccgcacgtcccaataacctgtaaatcctggactttatcgccattttcaaaagcgatactgtagatttgactatcacggcgtaccgtgacttctacccgcttggataaggcgttaacaactgaaatacccacaccgtgcaaaccaccagaaaactgatagttcttattggagaatttaccgcccgcatgtaaccgacataaaatcagttcaacagcaggaaccccctcctctgggtggatatcaaccggcatcccacggccatcatcaatcacttcgagtgattgatcggcgtgtaaaatgacgtcaatacgacgggcatgaccagccagcgcctcatcgacgctgttatcaatcacctcttgaccgaggtggtttggccgcgaggtgtccgtatacattcctggacgacggcgcactggttctagaccgctgagtacttcaatggcatcagcgttatagctggattcagtcatggtttgattaatattcggctaatggttggaaggctggcggtgacataccccattgaccatccggccccggagtcattaggtcgcgcttacaccgcctaatatcaggtgttcgccagccctaaaaaagtcacaatcggtgaaaaatagtgatcaaagccgataaaggcatgatttccacctgattctacggtttgccggcaaggggtataataggcaaccgcttgacgataatcgaggatttcatccccggtttgttgcaataaccagagtaaatccggtgattccaacttttcaatttgcatggctttcaggtcataaatgtgccgagactctaacacatattgttgacctgtgtaggggttctcgttcttaccaagataatcactgagtagctcatacgggcgtactgccgggttcaccacgacggccggaataccaaaacgctgggaaagccaggttgcaaaataaccgccaagggaagaaccgacaataccaatagattgcccggctttatccatcacaatgttctccagcatttctgccgcaggtgccggataaggaggaagttggggggtgagcatctctatatgcggatagtgttgctgcaaccactctttaaacgccgtggctttcgctgatcggggagagctattaaaaccatgaatatataaaagtgtactcatcaataaccatccgagtccatatcagggcaaaattcgtcactgtctaaccgatgaacctcagtttccagccccccgtcaggcagtaaatcgagataacgccaccctggtgccacagcatcaagcgtaaagttagtacaatgtggtttaaattgcacacaggtcgaagggctggctagcaagcgcttaccataccagtcaagatctaaatcttgatgaatatgaccgcacaataacgtagtaactcggggataacgagtcaggatcgccgccaacatatgcgcgttgcgcaaactgtgttgatcaagccaggtgcaacctgacggcataggatgatggtgcaacaatatcaaggtgtaacgttccggatacgcgattagacagcgctccatccactccaactgatagtcgctcaactcaccataaggtacgccaaatacttggctgtccagcaacaggatctgccagtgttctcccgccaggacctgttttgaaggggcaatccccgcctcagccaatgcaccaaccattgctggctggaaatcgtgattaccgggcagccaaacgcaaggcacaggcaggcgagatattcccttcgcaaaattctgataggcggcgacagagtggtcctgagccaaatcgcccgtggcaacaaccagatcaaacgggtgctgttccgcaataatcgcgtccaataccgcgcgatagctgtgaaaagtattcacacccagcaatgtctcatgttcgccagcaaagaggtgggtatctgttatttgtaaaattctaaccctggccccactcgccataggcagtttaaacaggctttccaaatggtatccttgtttttgccgccccccaaccagatagttatgcgtattatgactatctgcaggcaaggccataagtctgtctaacaaaccggaacggccaccgctccatgcgccaaacaatagcgcaaccaatcagcaagaaactggttaatttgatgcttttcatcccgctgatgcaactttttattgggataatcataacttgctttgaagcgagagatctgctgactggcacacacttccgcgaccattgcatcatgataaaggcgtaccaccattgatggtaggctccaatgactggcagcaggggccgtttgtacaatctcgacgaccgaagtgtagcgggttgattcaatgattgtcagccgataactgacttctttaatctgataagccacgctttcacccacttcattgatacgcgggattaatcgacgtaattgtgcgtagttaatttcgcacaaacgcatcatctccggaaaatcaggcgtgtagcgtttactcattcttatctcgcttttttatttatcccgcattttctatcgctgccattcagctcttagcgcttgatggtgcaacgccagccactgtaatgcaatgactgaagcggcgttatcaatcacaccttcttcaacccaacgataggcttgttcgcggctgacaacatgcacccgaatatcttcattttcttcggctaagccatgaataccgctcgcggtcgtcgcatcaacttcaccgaccataatggataaacgctcactggtaccaccggggctggctaaataactgagtacgggtttacagcgaccaacctgaattcccgcctcttcttctgcctcgcgccgggcgacctcttcaacgctttccccctcctcaatcatcccggcgaccatttctaataaccaaggagaaaccgcgctatcaatggccgcaatgcgtaattgttcaaccaataccacttcatcgcgctgtggatcataaggcagtagtactgcggcatgaccacgctcaaaaatttcgcgcttgacctcaccgctcatttcaccattaaacaagcgatggcgaaaccgatatgaattcagtgaaaaaaaaccccgatacagtgactcacgtgcaataatttccacatcattcttgtcaaaagtcaccggtgaggattgctttgatgtcatatacttctctctttacttaagtaacgcgcctgaattctgtttttaccctataacggtttggtaatcacgcttttactggtatcaccgtcatgaacttaacccagtgctaacgcaggcaacaggatttttaaaatagcaggcattatcagcgggtagaaatgaagttgtttgataaagcgagtttaacaacggtagttggataaaaattgtttgataaacatggctagataacgatcagtttctgaatactcgtttagctttgtgatagatttaagtaaattaaggcaggatggcacaatcggccaccttatcccattggcagactctgatagaatcgtcaacaattcgtctatcgacagctaccatgtaacattgctgcacaacaaggattgcaaatgaagaaactgctcccccttcttatcgggctgagtctggctggtttcagcaccatgagccaggcagagaacttgctgcaagtttataagcaagccagggatagtaacccggatttacgtaaatccgctgctgatcgcgatgccgcatatgaaaaaatcaatgaagtacgcagtccactgttgccacaacttggtttaagtgccggctatacacatgccaatggatttcgtgacgcgtctaacagcccagatagcaataccacatcaggctctctaaaactgacccagacaatttttgacatgtctaaatggcgcgccctgaccttacaggaaaaagtggctgggattcaggatgtgacattccagaccagcgaacagcaactgattcttaacactgcaacggcttatttcaacgtactcagagcgattgacagcctctcttatactgaagcgcagaaacaatcggtctatcgtcagttggatcaaacaactcaacgttttaatgtgggtttagtggccattactgatgtgcagaacgcccgagccagctacgataccgtgttagcggcagaagtggccgcccgtaataatctggataacgcactagagagcttgcgccagattactggtgtttattatcccgaattggcatcgttgaatgtagaacgattgaagactcaacgcccagatgcggttaataacctattgaaagaagctgaaaaacgtaacctttctttgctttctgcccgtttgagccaagacttggcacgtgagcaaattaagtctgcggaaacgggctatatgccaaccgtcgatttgaccgcctcatcttcgataaccaatacccgttacagtggcggaacccccagttctcaacaggtaaataatgattccggccagaaccaaattggcgtgcaatttagcttaccgctgtacagcggtggtgccaccaattctgcggtgaaacaagcgcagtataatttcgttggtgccagtgagttgttggaaagtgcacatcgcaatatggtgcaaacgcttcgctcatcatttaataatatttcagcctcaatcagcagcatcaatgcttatcagcaagtggttatttctaaccaaagctctttggatgcaatggaagctggctatcaggtaggcacccgtaccattctggatgttttgactgcaacgactaacctgtatcagtccaaacaacaattggctgatgctcgttataactatttaatcaatcagttaaatatcaagtcggcactggggacgttgaatatgaacgacctgatggcactaaacgccgtattggataaaccggtcccgacgtcagcggctgctctggcaccagagaatactcgccaaactgtcgctacaccacgcgctcagtaatcagtaataacccactccgtcagcggtttggcttcaccgggcacagtcattggctgcgcccggtttattttttgcctccctcgattttacgaccaaacgttattcgttttgctaacacggtgagttttgctagcaagcacttttcgtcaatgaaaaaagtgaagtgactctcagcgatgagtataactttgtaaaatctgccactcacactcccctgtgctttaatttcaaacatgtttcccctattcttagggaacttcctgggaagggcattgaatgcccagattaaagagataaataatgatgaaacggactaaaaacatcaatcaagagactttccgtaaatcctggcgtagttaccgccttgcgcccgtagcgttggctgtcagtgctgtgtttatgctggctggctgcgaaaaaaccgatgaaaccgtctctttgtaccaaaatgctgatgattgctcacaggcgaatccgtcccagagtgcagagtgcaccaccgcttacaatacagccttgcaagaagcggttaaaactgcgcctaaatacgcgacccgtgaagattgtgtggcagaatttggcgagtctcagtgtactcaagctcctgctcaggcgggtatggtaccaacatcctcgtctgaaaccacggccgcagcaccacagcaaagcggcagcatgtggatgccattgatggctggttatatgatgggccggatgatgggcggcggagccagccaacctttgtttacctcaaaagcaccgaacagcccggctaacggcaaatttgtggatgcgagcggcaaaaactttggcgcggccaccactggccgtaccatgaccgtgcctaaaaccgcgctggcaccgaagcctgcggtaaccaaaactatcactcgtggtggctttggtgagtccgtggcaaaacagtcctctatgcagcgtagcgccgcaacatcatccaaaaccaccacacgtagcatgggtggttaaggctgattaatgaaacgtttagcgattagcgaacgcccggactggcgtgaaaaagccactgagtttggttttcgttttcacaccatgcatggcgagccatactggtgtgaggatgcttactacgaattcacactggcacaaattgaagagttggaagaaaccaccgcagaattacaccaaatgtgcctgcaagtggttgaaaaagtcattaacagcgatcagttactgaccaagtgccgtatcccgaagcattgttgggagtttgtccgtcattcatggcgtagcaatcagccttctctctattcacgtcttgatctggcctatgacggtaaaaacccggcgaagctgctggaaaacaatgcagataccccaacctcattgtatgaagcggcttttttccaatggctatggttggaagaccagattagcgctggcaatttgagtaccgattctgatcagtacaatagcctacaagaaaagctgattgagcgctttgtcgagctacgtgataaccatggttttagcttgctgcatctggcctgctgtcaggacagtgaggaagatcgtggcaccgtacaatatttgcaagattgcgcactggaagcgggtctaccgactgaattcatgtttatggaagagatcggtttaggggaaaaagggcaatttactgacctggataatcaggtgatcagtaatttatttaagctctatccgtgggagtttatgttccgcgaaatattctccaccaaactggaagatgctggtgtacgctggctggagccagcctggaagagcattatctccaataaggccttgttaccgctgttgtgggaaatgttcccaaatcaccctaatttactgcccgcttacttcgcggaagatgaccatccaccgctggatcattacgtcatcaaaccgttgttctcacgggaaggtgccaatattcagatcgtagaaaatggcaaagaagtcgctaaggttgatgggccttacggcgaagaagggatgattatccagcaattccacccattaccaaaattcggtgatagctataccttgattggtagttggctggtcaatgatcagccgtgtggtattggtttacgtgaagaccgtgaactgatcactcaagacctgtcgcggttttatccacatattattttgggataattatagtaagggaaggcaatgcaccttcctttaccatacccaaagtcattgccgttgcagctaggcagcaagtaagtgaatcccgatgagcttactcaagtaagtgattcgggtgagcgaacgccgctaacaacgctgcggcgtcaaggacaaagggtatttagccgatttgcaccgacaacatacttaacgaccccatctcaaccccatccgtcgggatcgaaaccggctctttaccatcccaactccctagcacatacagcaatggcaaataatgctctggcgatggattggataatgccgcgccttcatgttgcataaagttaaccagcgggtggtcatccccttgataacttaaattatcccgtacaaattgattgaaagactctgcccatggatatggactgctctcaccctgccatttgcccagacgcaggttatgtaccacgttaccgctggcaacaatcatcacgccctgttcacgtaatgctgccagtttctggcctaattcataatgataagccgcaggctgcgtaccatcgatactcagttgtaccactgggatatcagcctcagggtacattttgattaatacgccccagctaccatggtccagcccccactcaccggtatcagcccgtaccggtgtaggggccagcagttgttgaatatgcgccgcgagttcaggggagccaggagccggatactgtatatcaaatagcgcctgtggaaacccaccaaaatcgtgaattgtccggggatgttccatcgcagttaccgccgtaccacgggtataccaatgggcagaaattgccaaaatcatctttggacgcggtaatgtttcacctagcgtacgccatgcctgagtgtaactattttcttccagcacgttcatcgggctaccgtggccgagaaacagtgcaggcatacgaaaggtgttcatagaaagtccttactgttaagaaaaaaagagggggcgtttaaaccttaagtaatacattacgcgctttcttttcattaaacagccggataaccatgatgaagatattcaataaatttgaagggaaaacaaaggaggggtaacacaaatttatgtacaagctcaacgggcgtggcataaaggcagaaaataaccgggtggtagtttattcagatgagcagcaaatgcaaaccaatagcaacgataataagtagcaatggtaatgaatagcaacgacaaccaataacaacaacccggtgttgacgtgcaatatcaacaatcgatattaacaggtcagcgatattaacaggtcagcgacattaataaggcagccacactaaccagccagcaatattaacaagcctatgatattaaccagccagagatatcaccaaataatatcaggcgagatcgccatcagattagctggctttcttcgcgcgagattggagataagccgccaaatcgtcaatcgtcacgacgggcatatcatgcaatttagcaaacgcaatcacttctggagcatgagccatgctaccgtcgtcattggtcagttcacacagcacaccagccggtttgtaacctgccagtgtcgccaaatcgatagacgcttcggtatgaccacggcgtgataatacgccaccaggttgaccacgcagcgggaatacatgccccggccgattaagatcagcaggtttagcgttatcagcgattgccttacggatagtggtcagacggtcagccgcagaaaccccagtcgtcacaccttccgccgcttcaattgtcacggtaaacgctgtctggaattggctggagttatgggtaaccatcatgggtaaatcaagctgctggcggcgttcatcagtgatacacagacagacaatgccactaccgtggcggatggtcagagccatttgctctagcgtcattgcttcagcagcaaaaaccatatcgccttcgttttcacgactttcgtcatccaacaccataacgccacggccattacgcagggcgtcgattgcacgttctacacgctcaacaggcgtgccaaaatctgagagaagcgtctgattcatggtaaagaaacctcattaaaaaattatggattaccagaatcagggcggtcttgaggagtaaaaggccaaaaataaatagccgaaataacgcaagcggaccatatccgttattttccaagcgacaaagatgttggttgttctcgttcccccaaatcgcttactcatgtaagcaccttagggtcttcgtggtgaccaacgccccgcatcttgaaatctatagggtgtataagcccggcagataccgttactctctcccatccggactataaccgtcggccccggaattacaccgggtctgctgacctctaccttgctctcttggataagagaaacaatatgagcgctcgcgggcttttgcaccaccgacgtgactatatcgtcgcaatacaatttaccgccggtggggactttcaccccgccctgagaataagccccatgactatagcgctattgattcatctgggcaattaccaaaatgcagaattaaaccttgcgtccagaggtttatacaatcagcatcgcgcattatactgatcgagagtcaccacacatctacttagggaaatatcatgattgacccgaaaaaaattgagcaaatcgcccgccaggtgcatgaatctatgccaaaaggtattcgcgaattcggggaagacgtcgaaaaaaaaatccgtctgatactgcaatcgcagttaacccggttggatttagttaatcgtgaagagttcgacgtacaaactcaagtattgctgcgcaccagagagaaactggcgttgctggaacaacgagtgggggcacttgaggcaaaatttaacagcgccccggcggatcacggcgaaaagaccggggaataattgggctgaataagccgccacgtatcagcggcgtgccagtagaaatcacgtataacgctcacttacgtataaacatcaatcacgtataacaaccaattatataaataaaatagaggcagactgctgacaaaccccgatgacgcgatcttgaacggtgaggataggcagaggagtaaagcgtccgcgccaaggatggcgcggctcgagcctacatggatgtagttacggcgtctttacgatctgcctgttctctccgtcgcgggcactttgtcaataacctcagggcgcccatcaggtgccctaaatattttgtattccaacacattaaggctgagttagctgcgtctttggcttagacatcaacatccacaacagcgcaaacatcagcaaagcgtatacacttttccagccaatcatgaccagtaatacacagcagagaagactgccaatcactgacatcacccgcgcgcgtccactcaataagcggatccctgccagcatacacagcaagtaaatcagcacgaaaataccgttggcatacacaatcagtaaatccagtggcaaagcaagccagtagatcagcagcgcaaagaccagacaactgccgaccacagcggtcagcgcattaactggcgtttgaccggcagataaacgcgccagtttactttgtggacgaacctgagactgcgaccacaccatgcgagcaaaactttgagtataaatattcacgctggcaaaacaggccagatagccaataatgcaggcaatccacagcgcatgttcaccaaacagttgtaccacgatccccggcagtgaagccgcggcagcctgcgactcaccataagcctgaaaatgcagcaccgcgacagtacacccccaataaaccgcaccagcaaccaataacccgacgatcaaggcccgtgggaagtcacgctcaggatgacgaaattccgttgccaaatgagcaaaagcctctaaaccaacaaaacaccagaacatcacggctaacgcgttgaatatattgggtggggaaacatcttgtagcgctggccatgggatctgcgataggcggatatccccctgccaccaaattgcggccaccaacgcgattaccagtagtgcaatcacggtttgtagattggcgcttgaaccggcgctacgggtgcccagtagccagataaccagcaaggtcaccagttgcaccattagcaacccggtgtcactccaaccaaacatcgcttgccagaatccggccgctatttgcaaggccgcaggcagcccgaccggaataaccgataaaaatagccagcccgtgactttacccagtttcggaccaaaagcgatggcaacaaagtgtgctgccccccctgcactggggaaatgacgccccagcgccgcaaaggcgatagcgattgggaagaccagtacgattaatactggccaggcccataaactatcatggcccgccaacattgccgccaatgctggcacagcaaaaacccccgtccccaacagggaagtggataacaacccaacgccttgcgccagacttaactcttgctttaacccacccactgccacatccttatgcgccagcgctctggcgctgacttagccgcggccgtttttgatcgactgaataatattggtggtagagacaccatcttcaaaattcagtaccttaacctcgccaccggcggcccagacttcttcgctacctgcaatttcatggggcttataatcgccgcctttgactaacagatcgggcaaaatatcagcaattaaacgctgtggcgtatcttcttcaaagggcacgacccaatccaccgcttccaacgcacccaagacaaccatacgttgttctaatggattaaccggccgcttttcacctttcagccgcttggtggaagcatcgctgttcaccgccacaatcaggcgatcccccagcttacgggcattggccagataagaaacatggcctgcatggaggatgtcaaaaatgccattggtcatgaccaccttctccccacgctggcgagcctgcgcaaccgctattttcagttgctgctcatccatcaccccaaaaccggtttctgcacggccacggatcgcgttttccaactcaatcggagaaacggtcgaggtacccaatttacccaccactacaccggcggcagcattagccaggaaacatgactcttccaggctgttacctgcagccagcgcggcagccagcacgccaataaccgtatcgccagcaccggtcacatcaaacacttcttttgcctgagtcggcaaatgtagcggcggtttacccagttgcaacaaggtcatgccttgttcagaacgggtcaccagcaatgctgaaagttcgaaatctgccaccagttgcataccgcggttaaccaactcttcttcatttttacagcgccctaccactgcttcaaattcagacaaattcggcgtcaacaatgtggcaccacggtagcgctcaaaatcactgcctttcggatcaatcaaaaccgggacattcgctttacgtgccagttggatcatcggctgtacgctgttcaatgcccccttggcataatcggacagcaccagcgcgccaatctgtggcaacgccagttgaatgcgctcgaatatcggcgtgggatcaacaccgtcaaagccctcttcaaaatccaggcggattaactgctggttacgggaaagtacccgtaatttggtaatggtcgggtgagtgggtaccgagacaaaatcgcaacgcacccgaacttcgctcagcttgcagatcagcgcacgcgccgcatcgtcaatgccggtcaacccgactaagcgcgcaaccgcgccaagggaggcaatattcatcgcaacgtttgctgcaccaccagggcgctcttcgatggtatcgactttcactacaggcacaggtgcttctggtgaaatccggctggttggcccgtaccagtagcggtctaacatgacatcacccacgactaatacaccagcacggcgaaaatcaggcagcgtgactttcatacatttgccccccaacctgagttgttattaaccccgaatgcacccatcccttcgctccaatattgtgttcatcatatagcgccaaataatatcacaggcaccttatattccattaatatctggaatctatcgtattagctcacattagcgtcgtttgccgccaaccatttatgccaactggccgccacttgctctctttcggctataaagctgtcggctgcgactttgctcgattgttcttgcaaggccaaatgatggatctcatcacgcatcgtgacataagcacgggtgagcgcggcggcctcttccggcgacatgatgtcgtaatgagccatcgattcaaaaatacgcacattgtctgaccagcgagtcaatcgcggttcgctggctgcgtagcgcagcaccagatattgcgcgataaactcaatatcggtgatcccacccgcatcggctttaatatcaaagatatcacgttgtttactgcccagatgattacgcatcttttcccgcatttcgcggacttcctgctgcaactgcggatcttcgcggtggcggcagagaatttgctggcgaatagcatcaaactgttgatgcaattttggggaaccatacacaatgcgggcgcgcaccaaggcctgatgctcccaagtccaggcttcattacgctgatagtcggcaaatgcctcgatagtactgaccagcatacccgcctcacccgaaggccgcaggcgtgcatccacttcatacaaaatgcccgatgatgtgcgagtgctgaacaaatgcataatgcgttgggccaaacgcaggtagaactgacggccatcgatactgcgatcgccatcggtcatcacatccaatgggcaatccaacaggaagactaaatctaaatctgaactgtaccctagctcccagccccctaattttccataaccaataaccgcaaaaccacggccttcgctttgctgtaaatgactaggctgaccatagcgggcgaccatctgattccaggcctgttggataaccgcatcaataatggcctcggccagataagttaagtgatcgctcactttcattaccggcagcgcctcagtgatatcaccggctgcgatacgtaattgctgcgcctgtttaaattggcgtaacgcctctaattgctgttcttcatcatcttctggcacgcgcagcaaatattggcgtaactcatcgcggtaagcactgggagccagaggctggtacagcgattgcgggtcaagtaactcatctaataacagtgggtagcgtgccagttggctggcgaccatcggcgaggcagaacacaggcggataacatgtttcagtgccgcatggtattccaccaataactccagatacgtggtacgcgtcacgatactgagcaacagtaggataaggcggctgagggcaacattggcatcggggcgcggacacacttcagcaaacagccgtggcatcaattggtccagcacttcacgacctcgcggcccaatagtgcgtttatcgacatcatggcgaaagccactgatcgtcgccaatagctgacggcgggcggcctcctccagatgcggtgtcaatggggcgagatcactctcttccagcacatcctgccataggcttttatacaacccatggctcggatcttcgccaatatcaggggtttcatcgccgataaggtcatcaaataccacacgaacggcctgcatgtgattttccagcgcggtactcatcgctgcccaatccgcgtaccccattccccaagctaaccgggcttgattcagtgggtcattgggtaatgtctgggtttgctcatcagcaatggcttgcaacaggttttccaaacggcgcaaaaacaaataactgccactgaggtcagccacttgctgctctggcagtaaccccagttcagccaccgcctgcaatgttggcaaaagtgcacgctcttgcagccgaggttcacgccccccgcggatcagttggaagacctgagtaataaattcgatctcacgaatgccaccggcacccagcttgatattgtctttcaacccccgccgccgaacctcacgggcgatcatccctttcatattacgcagtgattggatcacgctgaaatcaatataacgacggaagacaaaaggccgtagcatttgacgtaactcttggctatagggatcgtcagcaccgcccataaggcgcgctttcaccattgcatagcgctcccagtcacgcccttgctcctgataataatcttccagtgcggcaaaactcagtaccaaggggccgctgtcaccaaacgggcgcaagcgcatatccacccgatagacaaagccatcaatagtgtgttgatcgagcgccttaatcagccgttggcctaagcgggtaaaaaattgggcgttatccagctcacgccgcccgccttgagtctggccattttccggataagcaaaaatcagatcgatatcggacgagaaattcagttcaccgccaccgagtttccccattcccaaaatcagtagcggctgcggcactccctggcgattacatggggtgccaagctcacggcaacacacctgatagagccaatcgcgggcagcaataatcatgctctccgccagagtactcaattgctgtaatgtctccgccgttccactggtttgcaatacctgtgaccaggcgatacgcaccataacccgacggcgaaacaaccgtaatgccgttaacaatgccgcttcatcctgcaccccggccagcgcctgactcagccactgcgaataatattgccactcctgcggctgcggaggttgctgatgcaactcctccagccactgcggatgaatcagtaacatatcactgacaaagtcactcagcgccagtaccgcaatatcttcatcacgtaaatccggtggcgcgggtaactcagaaaagcgctgcttgatactctgcgcttgaatctgtaattccgaagggagtggcaacatatcagattccttgtatccccttcgcatatttcgtaggtgaaattgcagggctattttttatcgatgttgtaagttttttataaatgccgtagcgctgtttttataaataaccccctgcaacgccaataactttggttatatattcgattagcgaacagcaccgtttaaccaaaaggcggcctgagatagtgcttctttgcgggcagtatctcgccagtggccctggcgcgccataatcgcctgctgtaaaccaaaccaggcatcgatatacggatgccattcactttgtggatagaaaccagaaagcagttggaaggcgatgagctggcggttcagacgggggagttgtgccaaatagccatcatcatcaagattgtggccaaaagcctcttttaaatcggcggcactgcggctgagcataatgtcacagaagcgtttaaacgagccatcgaacttagcttgtgctttggcatccataaatggccgccagcctgcggtgatcaaccatgatgtaagcgccaacttacatttcagatagtcaacgctgtaacacaacaacgctgcatcgacactcttcggctctaattgcggctcaagggcaatcagcaacgcacgtaactctgtactggctttccgtggcaccaaaccgccaaaaatagccaacgattggcgaaccatagccaaagcgtcgataatcatggttttggccgcaggttccccacgtaaccacagctcttcatgatattgccagtgttccaatatgctttccaaaccaccggccatcccctgctcaaccgttgatttcgccacgggttgaaataccaggaaaggccgtagctcacgtggcggattaccttgcgccagatgataaccacgtgccgccttactcaagttgctctggcgtaagccacccatttttgccaattcggctgccagtgccaataaatcgccctgagtgccctgtttcagctccagttcaatctcactcaacggttccgacaacgtatcagcgctgatagaaccttggtcgagggcaagttctatctcgctctcaccgtaagtgattacccacttttcgcgggtgaaatcagtacggaacaacggctgtaattccgcttgcaacaaatcaaccgcccagccttccggccagatatcctgcgggaaacgcgctaaatccagttggtcgctatcaatatcgacattatattcaggccgctgatgtaaaccgcccacgaccttaccgccggtctttaccgtcatttcataacggccatcatagccgcggatacgtaaaccgatatcattctggcgcaaccgcttatccgccgtgtcaaaatagatattggccagtgtttgtgggggaaaatgctggtttttctgggactcaatccactccggcaaagcagcaatggccgcaggagtagcaataaattttaattctatttcaacggtcataatttcattcacaccggtatgttacgagatgacgggcattatgcacctttcgcttcgatttgcctgttttgtacagataaacccgcttggcggcccccgctaaaactctattttaacctgttttagccgatctgccctacgtcttcataagacaaattttcacggcagttaaaataagcagaaatagggccaaagccgcgctggctgtgagactaagacagttctcattccggtttatgcgttgcgtcggcaaactgaacgcactactatcgttccataaattcactcataaatgactctctaatgcagaaattacgcctaatttgcctcacgatactcagtttaagcctctcttggggcgcacaagctgaagaaaaacgctatatatcagatgaactggatacttacgttcatagcggtccaggtaaccaataccgtattgtcggcacactcaaaggcggggatgaggtcaccctgataagcgttgataacggtacaaattatggtcagatccgtgacagtaaaggaaaaaccacgtggatcccattgaatcagttgagtgaaacgccaagcctgcgcgttcgtgtacccgaccttgagcaacaggttaaaacactgaccgacaagctggctaatattgataatagctggaatcagcgcacggcagagatgcaacagaaagtggcggccagcgatagtgttatctctgaattgcaaaaagagaatgaatcgctgaaaaaccaactcattgttgctcagaaaaaagttaatgccgtcaatctacaattggatgacaagcaacgcactattattcttcaatggtttatgtacggcggtggtgttgcggggattggcctgctccttggtttagtgttgccacatttgatcccaagccgtaagaagaacaaccgctggatgaactgatcgtcggcgttattcgagcgagtaaatcccgatgaacttattgatcagtaaaattaacttgatcagtaaaattaacgacaagtcagtgactcgggttattgagtgtagtcaacgcacatgcagcttgaagtatgacgggtataaccacgctgtggcgtcaagaacaaagggttaactatgaacatctacctggtcggcggagccgtacgcgatagcttattaaacctgcccgtgaccgaacaggactgggtcgtggtaggggcgacccctgaacaattactgaaattagggtatcagcaggtcggtaaagactttccggtcttcctgcaccccgtcagccatgaagaatacgccctagcgcgtactgaacgtaaatccggccagggctacaccggttttacctgctatgccgctcccgatgtcacgctggaagatgatttattacgccgcgatttaaccgttaatgccattgcccgtagtgctgacggggaatttatcgatccctaccatggcaaacaggacttggaaaaccgagtgttacgccatgtctccgacgcatttggtgaggatccattgcgcgttctgcgggtggcacgctttgccgcccgttttgcctaccttggtttcaccatcgccccagaaacgatgtctctgatgagcaatatggcgcagagtggcgaactctccgccctaacaccagagcgcgtgtggaaagaaaccgagaaagcactgaaaacgcaaagcccacacgtctattttcaggtacttcgggattgcggtgcgttggcggtgctgttccctgagattgagcgtttatttggggtgccggcaccggagaaatggcacccggaaattgataccggtatccatactctgatgacgttggctatcgctgcacagctcagcccggaggttgatatacgctttgctgccctgtgccacgatttggggaaaggcctaacccccaaagagcattggccacatcatcacggccatggtccggctggcgtcaaattagttgagcaactgtgccaacggttgcggatccccaaccctgtgcgtgatttggctaagctcgtcgcggaataccatgacctaattcatacagtgaataaactccggccagaaactctgctaaaactgtttaatgccattgatgtatggcgtaaacctgagcgcctggagcagatgattatgaccagcgaagcggatgcccgtggccggactggatttgaaaacaatccctatccacaaggggattatctgcgggccgccttccagattgccaacggagtatcaatacaggaagtggtcgccagcgggttacaaggcttggctattcgcgacgaacttcaacgccgccgccagcaagctctggccgagtggaaacagactcaggaaacacctttaatataagtgactccccgttcgtttccccctgtaaaacaaggggtttcagactcctgcccccccgatgacacgatcttgaacggtgaggatgggcagaagagtaaagcgtccgcgccaaggaaggctatttttatacagggaagccggcgtctttacgatctggctgttctctccgtcgcggacatgttgtcaaaaacccattaaaaacaaatgattatttatttacagccacaattatctcttacataaagacccaatacaccaccgccgcaacaataaagcggtaaatggcgaaaggaacaaaagagatccgtttaatcagtgacaagaaggtcttgatggctattagtgcgacgataaaggcggtgataaaccctacggcaaacatcggtaaatcgcccaatgtcaggaaatgcagactcttatataaatccagcccactggccccgatcatcatcggtaccgccagaataaacgagaattcagaggctgcgtaacggttcacgccgaccagcatcccaccggaaatagtggcgccagaacgagagaaccccggccataatgccaaacactggaagcaaccaatcgcaaaagcctgacggtaggtaatatcatccagcccgacagccttaggatttttaggtttcaaccattctgcggccagcaataacaccccacccgccaccaaggcatacatgacactttttgggtcaaatagcgccttgataacatcatgaaatgccaaacctagaatcaccgcagggatcatcgccagtaaaatatggcccagagtcaaatgaccattggttttcccctcgtggggcaccgcaccaaagtgaataccaatcagaccgaataagcgccgccaaaacaccacaactacggccagaatggagcctaactgaataatcacttcaaacgtttttgctttatcaccggtaaaccccagcaactccccgacaataatcatatgcccggtagaagaaaccggcagaaactcagtcagcccttcgaccacacccagaataaaagccacaaacagcgaatacatatccgtcatctacaatacccaagaccctgtaatggaaaaccacaaaaaaacggcaatgctgaaaacagtgccgttctatttagaatttaattcatacccaaaataattggggccacagcccgggaagctggctctcatcagcgattcggctgaaaggaacacccttcacacggcggcgacttcaagttaagaaggatacagaaaatttatcacgaacctcgacacaatcagacaacattatcaatgcagaatgatatttttatgtcatatggcgacaaaaggtcagcttagccgttggccacgttcaataattacaccaacatttttggcttgggcaacagcccccggcttgctaactttgatgcgtacccacggcgaattaaagcgtcgtaataacaactcggctacctcttcagcgacccgctctaccaatgcaaaacgctgtgagccgacatgttgtatcaccgcctcactgatatcagcgtaactcaggcagtcattgacatcatcactgcccgccgctttacggttatcccagcccatttcgatatcgaacaccagcttctgctggatggtctgctcccagtcataaaccccgatggtggttatgacactgagttcctcaataaatacgatgtccatcacgtcattctctgtttttgtgcctgccggataccacttccagccgaatatgcgtattatccactgatgttgcgattaaaacgaccattattcaacggggcggtgttatgagtgctatcgcgcttggcatgattatcttcgcgtatttgtgcggctctatttccagtgcaatcttggtatgccgggttgccaggctgccagatccacggacacatggctccggtaatcccggtgcgactaacgtgctgcgtattggtggccgtacagcagcagtggcggtattgctctttgatatattgaaaggcatgttgcccgtttggatcgcttatctgttacacatcccgccactttatctcggtttgaccgccattgccgcctgtctcggccatatttatcccgtatttttccactttaagggtggcaaaggtgtagcaaccgcatttggtgcaatcgcgcctatcggatgggatttgaccggtttgatgaccgggacctggctgctgacggtattattgagtggttattcatcattaggcgcaatagttagcgccttgattgccccgttttacgtctggtggttcaaacctcaatttactttccctgtcgccatgctctcttgccttatcctgatgcgtcaccacgataacattcaacgtttatggcgtggcaaagaagggaaaatttgggacaaacttagaaagaaaaaacagaaaacgcctgcagaagaagccgcagagttagaagagaaagaagattagttttccccaaaaccgagaatggctgcggcaacacagccacagccacgcccagccattcgacacccctatcagaatgactgagcatgagcgaggcaaggcgcaaaggaatgaaaaaacgcagtggactcttgtccatgagtattttgaatgactgcggcaacacagccgcagccacgctcagccattcgacacccatatcagaatgactgcggcaacgcagccgcagccacgctcagccattctgatcagacttttggtaactcagataacggccaccgcggccgcaccgacacactcaactcactgttcaggttacttcgcaacctgaccatcccggcataggcaatcatcgcgccattgtcagtgcaaaattcgggtcgggcatagaatacttcaccgcctcgtttttgcatcatatcggccagttttaatcgcagtgtctggttagcgctcacgcccccggcaatgactaagcgtttaaaacccgtctgatctaatgcacgtttagacttgatcgccaacgtatcaaccaccgcatcttcgaatgctcgggcgatatcggcacgggtttggtcatcatcaccattagcacgaatagtattcgccgcgaacgttttcaggccggaaaaactaaaatccagcccagggcgatcagtcattgggcgcggaaaggtaaaacgccccacagtaccttgttgagccatacgcgacaacattggcccaccggggtaatccagccctagtagttttgctgtcttatcaaaggcctcgcctgccgcatcatcaacagattcgcccaacagcaaatattcaccaataccggtcacactaatcaattgggtatggccgccggataccagcagcgcaacaaacgggaactctggtgcattttcttccagcattggtgccaacaaatggccttccatatgatgaaccggtaccgcagggactccccatgcgaaagctaatgcccgaccaatggtcgcccccactaacaacgcccccaccaaaccagggcctgctgtataagccaccgcatcgatatctttggcgctcaaattggcttctttcaacgccgcctgaatcaggggtacggtcttacgcacgtgatcacgggaggccagttcaggtacgacaccaccgtagtcagcgtgtaattttacctgactgtacaattggttagctaacagaccggctttatcgtcatagactgcaattccggtttcatcgcaggacgtttctatacccaatactcgcattacatttcccatcattcacgtgcggccgacagtttagcataacagcgcccgcagtcatgatttctaatccccaccttcgcggggaaaggcaatattttcggcattggccgcaaatgtgttgtttataatcgctaatagctaatagctaatctctaatcgctgagaatgactctgtgtgaaaaaaatgttgattaattcgatcaccggccctgtttagtatataatcagcggccgtcgcactcctggcaccaactttttttgtaaaagcgggggcgacatcacaggggcgtgcctgtttcaatttgctgtggtgctttacaaagcagcatccattgaagtaaaattccgcaccattttgagaaggctggcgattggccagcagcaaaccgatttctattgaggtgagaggcacatgccggtaattaaagtacgtgaaaacgagccgttcgacgtagctcttcgtcgtttcaaacgttcctgcgaaaaagcaggtgttttagctgaagttcgtcgtcgtgagttctatgaaaaaccgactactgaacgtaaacgtgctaaagcttctgctgtaaaacgtcacgcgaagaaattggctcgcgaaaacgcacgccgcactcgtctgtattaattcttcgggggtaaccccaacgcgtggttttttcatttcgaagaacgcgcagatcgagtagttgcatacgaaggccgtgctttccgaaaggaatgcgcggcttgttctcgtttatggactggcgaataggggcttatggctggacgaattccacgtgtatttatcaatgacttgctagctcgcactgacatcatcgatcttatcgatgctagggtaaagctgaagaagcaaggcaaaaattaccatgcgtgctgtccgttccatcatgagaaaacaccctcattcactgttaacggcgaaaaacagttttatcactgttttggctgcggcgctcatggtaatgctgttgattttttgatgaattacgatcgactcgagtttgtcgaaagtatcgaagaattagccaccatgcacgggctggaagtgccttacgaggcaggcagcggcaccactcagatcgaacgacaccaacgacaaagtctttatcaattgatggaaagcctaagcgcattctatcagcagtcactcaaaggccagaatgccaaacaggctcgtgaatatcttaaacatcgcggtttgagtgaagaaatcatccaacattttgctatcggttttgcgccccctggttgggacaatgccttaaaacgttttggtcgtgatggcgagagccgtacagcactgaacgatgccgggatgctggtaactaatgataccgggcggacttacgatcgttttcgtgagcgcgtcatgttccctattcgcgataaacgcgggcgggtcatcgcttttggcgggcgaattctgggtgatggagtgccgaagtacctcaactccccagaaacagaaatttttcataaaggccgccagttatatggcttgtatgaagcacaagtcaatcatccaaacccaacccgcctactcgttgtggaagggtatatggatgtggtggcactcgcacaatttggtattgattatgctgttgcctcattgggaacagcgacaaccgctgagcatattcagctgttattccgcgccaccgataacgtaatttgttgttatgacggtgatcgcgctggtagagatgccgcctggcgagcattagaaacggcactgccctatctaaatgacggacgtcagctacgctttatgtttttgcccgatggcgaagaccctgacaccttggttcgtaaagaagggaaagacgcatttgaacaacggatggaggcggcacagccactctcaaccttcttgtttgaaacgttaatgccacaggtagatttgagcagccctgatgggcgcgccaaactgagcacactggcattacctttaataagccaagtacctggtgaagcgctgcgcttgtacctacgtcagcaattagggaataagttaggtctgcttgatgacagccagctcgataagctgatgccaaaacagattgataatgcaaatacctaccagccgccccagctaaaacgcacaaccatgcgtatacttatagggctattggtacaaaacccacaattggctacacttattccctcattacaggggctcgaacaagccaaattggcgggtttaccgttatttattgagttggttgaaacctgtctggcccaaccggggctgacaaccgggcagttgctggaactgtaccgtgataataaattcagccaacaacttgaaactcttgcaacatggaaccacatgattgtagaggatatggtcgaaccgacttttgtcgacacgctagcgagcctgtatgactccattttggagcaacgtcaggaaacgctaatagcgcgggaccgtacacatggattaaacgccgaagaacgtaaagagctttggtctttgaatctggcactagccagaaaaaaatgaaacacccaacggcttaattgccgataaatgtgggggcaactccccacaatatgccgctatagcgggcagcggcgacaaaaaaaggccccaaatgtaattgttggcggtttcgccgaccgacaccaacccaaatactctgaagtgtggataccgtcttatggagcaaaacccgcagtcacagctgaagctacttgtcacccgaggtaaggagcaaggctatctgacctatgctgaggtcaatgaccatctgccggaagatatcgtcgattccgatcagatcgaagacatcatccagatgattaatgacatgggcatacaggtactagaagaagcacctgatgctgatgatttgatgctggccgaaaacaccacggataccgatgatgatgcggctgaagctgctgcacaggtgctttccagtgttgaatcagaaatcgggcgaaccaccgacccggtgcgtatgtatatgcgcgaaatgggtaccgttgagctgttgacacgcgaaggcgagattgatattgccaaacgtatcgaagacggtatcaatcaggttcagtgttctgttgctgaataccctgaagcgatcacttatctgttggaacaatatgatcgtgttgaagcgggcgaatctcgtttatctgacctgatcactggctttgttgatccaaacgccgaagaagatattgccccaacagcgacccacgttggttctgaattatccactgaagagatggatgacgaagatgaagacgaggatgaagacgacgacgcagaagacgataacagcatcgatccagagttggcgcgccagaaattcagcgatttgcgtgagcagtatgaaaacgcgcgtatggaaatcaagaaaaatggccgcaatcacgcgaatgctgccgctgaaattctgaagctttctgaggtgttcaagcagttccgtctagtgccgaagcagttcgattatctggtcaataacatgcgtgccatgatggatcgcgttcgtactcaagaacgtatcatcatgaagctgtgtgttgagcagtgcaaaatgccgaagaaaaatttcgttacgctgttttccagcaatgaaaccagcgacacctggtttaatgcggcagtggcgatgggtaaaccttggtctgaaaaactgaaagatgtctcggaagatgttcaacgcagcttgcagaaactgcgccagatcgaagaagaaaccggtctgaccatcgagcaagtaaaagacatcaaccgccgtatgtctatcggtgaagcgaaagcgcgtcgtgccaagaaagaaatggttgaggctaacctgcgtttggttatctctattgccaaaaaatacaccaaccgtggtttgcagttccttgatttgatccaggaaggcaacattggtctgatgaaagcagtagataagttcgaataccgtcgcggttataagttctcaacttacgcaacctggtggattcgtcaggctattactcgttcgattgcagaccaggcgcgcactatccgtattccagtgcatatgattgagaccattaacaaactcaaccgtatctcacgccagatgttgcaagagatgggccgtgagccaacgccagaagagttggcggaacggatgttgatgccggaagataagatccgtaaagtgctgaagatagctaaagagcctatctccatggaaaccccgattggtgatgacgaagattcacatctgggcgatttcattgaagataccactctggagctaccgctggactctgcaacttctgagagcctgcgctctgccacgcacgatgtgttagctggcctaacagcccgtgaagcgaaagttctgcgtatgcgtttcggtatcgatatgaacactgaccacacgttggaagaagtgggcaaacagttcgatgtcacccgtgaacgtattcgtcagatcgaggcgaaggcattacgtaaactgcgtcacccaagccgttctgaagtgctgcgtagcttcctcgacgattaattcgttagtgaagtaataaaaatcccggcatattatttgtgtcgggattttttttcctataaaccaaccacgtctacgctctcctctcccctacctcatccgtaaaaaaccttatttttgcatataaaacacgcatatgaatgagcagctctagacctgaggataaaaactaccgtataatcagcgcccaagcttggccccttagctcagttggttagagcacgcgactcataatcgcttggtcactggttcaagtccagtaggggccaccaaataaaacaaggagttacgttaatagcgtaactcctttgttgtttctgggatatgccggggatattttgcaggggtaatcatggggtttattggttattttatgcccgttcaccgcatcgccacacttcgatactacaatcatcggcgaggcgttggcttcttccactggtaagctggcgcactcatcctctggcggtgacgttccttggctgccagtgccgccgcctctgtaaatttacccaaatcaccccatcattttacggtaggcttcggcggcttcatccggggttaggtttgacgtttggatcgggccaccgttcgggccggtcaattcggctttcttcggtgcttcccatccgcacatttcagccagttgcttgatggcggctttcggatcatgcagcttaatttttagtccgtctttgccagtggataattcagcgacagcggccaggtgttcgggcttaatatccttggagtccttaaacttccatgacgcctgaaagaccggttgcccttcctcgtcctcgccaatctgataattgccaaatgtggcgatgtcatgaattgtcgtgcgccccatcaacgtgagtcgctctaatgcttcggtgtaggtcatgatggcctcgttaacggtttcgtgctgtacggactggaggaaggcttgaacgttactatttgttactaactggctggctttggaacgctcgccatcgcctctagctttaccgccagcccttcggtatgcctcggtttgattggcaccctctagcagcgcggtaacgaatctgcgctgtaattgcgtcagggcatcgaaaagcgccttctgttcttctgtaagcgtcatttcgaccccttataagttaaccgttttccaacattttaatttgtgtctcaatgagttcagccagactatcacatgactcccatacacgatctgtgccaatgcggtcacatgcttcccatttacccgtgcgcggatcatagtaaaacgtatcagtgttatttccaccaataacaatcaagccggtcatggtctcatctttaaaatcgggaatattcaaagcattattaaactcaataagcccagcatcatcttcaccgccactcataccataaaatacgcatccatcagcaaacgacccattgctaatacgcagaaaagagccgtattgcttccagaaatcaggctgttctgggcttatatctcgtccaaagtcataagtttccagcttgccggtataaggtggattgatgttgtatcccatacttttgctgatgcgagtaaactcattaaccgctttttctaaatttgccatacgcacctcacaaataaatcatgccattaaaaggcatcacctatattgattctctgtaactggctatctatcagttcagctaaggtatcgtaagattcattgatgtcatcaatcgctattcggtcacggctttcccatttatgggtattggtatcataaacaaaaatatcgctattgcttgaccctattgcgatcaatccgtccatgctttcatcgtacatctctccatcgcgcaacgcatcgttgttgtcgataaggcgattcccgatcaacttaccttcacaggctatgccataaaaataaacaccatcagcagcaagtccatcactcaagcgtaggaattcatgatattgcgtccagaaatctggctgattagattcaatcttacgcccaaaatcatactcaataacctccccctcatagggtggaattttcgggtaaccaatcgcagctcggtacgcttgaaaagtagtcactgctttttcaatgtcggtcatagatattcctatggataaattatgccttgaggctttggccataacacaatattagtgcccgtgggggtaagattttttgttatgtgcttctgcgtagtggtgaaggccgcatgctcagggcgcgtacttatcaacactagattatcaaaattgttattgccgctgtcatctagcggtagtttgtggtgtacctgataaccatcgggtacaacgcctttggctaggacgctgcgatcgaaggcgtcaaggcgtttcacaacttcgggattgttagctatatctttaaggaattttttacggacgccattatcaaactccttcctcaataaattcctatcagcagtcgagcgtcgtacgtaatccatcctcacaacatcgacgttttgtagcaatactttctgacctttataagtgccaaggtacccctctagtttttccagctcaacagctttccctaacttagcgacatcgcctaatgtgccaactttttctaccgttcccaaccccttagtacccgccaactccgccacggatgccgtgactaccatggcggccgcaccggctaatccattgcgctgataagcgtctgtcaccgcccctttcgtattatcataaatagccttgccagcggcttgttgattttgctgtcggactttatttattgcggcctgctctggattaaaggcccctgccatatattcttgggcagaaggccccatcaaagtacctagcccctcaagggtacctaccgcgctatcagcaatacgaccacgggcggcctcagttgtggctttgtcatgtgtgaaaggggtggcttcccataaggttttggcgctatcggtgacagattgccattttgcagataatacccgtccagattcatcggaagcgcgagttatcatagaacgctcggatacagaaggcctcaccttcattggcgacttcgttgaacgtggctttccacccgttcgctgatagttccgacattttaccccatcgtcaaacgccttgataatctttgcggcaccctcgaaacggaaagcatggggatcggcagacatcaactgaccttcaccattgatatagaacagccgggcagggccgtacatatcacttaacatcaccacgtcacccgaaaaaaccagtttttccagtttctctttttcacgtatcccgcctggacgtggctgatctggagagaatcgctgttcacgttcccgcatattgataaggtaacggctggtattgtgactgtcgtcaaattcatattcgcggcagatacgcgcccaggcagcgtgcgggctgattatccgctcgtattcttcaggggctaaattatctcttgaaaggtaatacaaatacattccgggcaggttgaagctcatatcccattccttgtggagttagtcgcaccggcattaccttacatttcttagggggttgtcgtccagtcacaggataccgacaaaaatccacccgccaaaagaaagagttaaaatcaatttaacaataatacctcacactgggatcgcgcctgatgtttgataaccaagcggcgactctgactccattctttctatgcgatatgcagaatcttcacggacgtaggcactgaaaaactgatcgccttcttcaccgaggataaattttccagcttgcctttcaaaataacagctaccacacgcacccagaatgtgacggaagtattttcggtgaaccgatggggtagcggttgttaacgtgtccatgtgttcctttctccacgttggcatgagttccggttgataatctgtaatcccccctgaatttagtcttacagactaacggagtttctggtacaaacatcaatacatcgttgtctggactcgctttgctctgatagaaatcacggccataaagtatgtcatgcatgacgtgttcatgtactttagcgaaaacacagcccctgatcgtacatggtcggctctcattaccgaagtaaatgtaaagaggaagccgcccttcaagccacgcctggatgaacacattagcatctataccgaagcaaggagccatttcctccaaagtggaaaatcgtgcgccatatctttcccctaaatccataacagagtaatgagtgcgcatattttacacgtaacttaataattcatcggtacttttagcaaagtactggaaatcgcggcgcatctgattagtcccctaggaaacccaagctccccttggtaaacgaccaacagataacagccttgcgggccgcccctatccgaactagaatcaggactgaaacaacgaggctttaaacatgacaaaaaaaacagcacacagccagatcactaaaactcaaatctaccgtgccgttgccagctcaaccgcaatcgaaaccggtgtttctgtgcaaaaaattgagcagcaactcaaacaaaatctggcacaggcgaaagccgttggcctcgcccgctagtctggcaagatatcgctcaccagccgcatcatagggctgtagttccctgatacacccgcctgaatcgccttgaagtaaaacgccttgtgttcatcccataagctgtaatccagcaagcccttccctgccagaacagccaatacatcgcaaagcagccgcgacaggcgcccgttaccttctctgaatgggtggatcaaaataaattccacatggcattcagccagataactaactagctccggacgagccagggatttcagctcaccagaccgagcgagaaactgtttctcaaaaccatcgatgagaagcggaatcctatcggcagcagcaaactgaaaaccatccttagtcaagttagcgttacgtaatcgccctgcccactggtgtacacattccccagccactggcggtgccactcacggatactattaaaagccagcgttgtggggagcgggccttcgataaacagctgttcgtacagcatcaacagcaaacccgactccagcgcctccatctcatactcatcgataatacccagtttgttagcaagcaccgtatcaccagagtcaggctgatacctctcctcagctgaatttagctcatattttgacaagcccttacctccgcccaaacaagttcacaacgttgttttcttgctgctgttgataattgttaacctgcgactcccaaagctcaagcgccttacgcttttcgaatcatgcttgaacgtcagatgtagatgtgctgttcctttctgatagtaacggatacgaaagaaatcatcttcgccacggcccgatatgacgattaggcgaatctacatcaggtaaataacccagcctgcttaaacattgttgcccgtaggacgacaaaactaatcgttcaactttacccttggtctttgcacgataaggcctaccccctcggggaataaactgaaccgctcggcaaaagccagtaatggcgggctccaccggtgctaacggctgaaaatgtcgccttttaaaatgcgttcagccagttcccaaggtgttattcgcatactcgtatttgcttgcatcatctcaagcgaccaatccacaaaacagcgtacccgtgcggaaaggtgcctattgctcggataaataatatggattgggcgggccttgaagcgccaatgcggtaataccggcaccaacgctccagcgcgtacccagctttccacagcgaaaggggctcctgggcagattccgctcccagccatgcacgaagcgagtgcaacatccggatcatcgaacagcaacccctcctccgcaggcaactcgaaagcgtcagacgttgactgtagcgaccaaataaaaggattgcgttgaccggtaaaccacgagattcggcgatgaacgcttagttcatgcggatgggtcaccgcaccagcagcttcgaggtaagccggggcggcataaagccccaaatgtacgtcacagacgtggcgcgcgatctggctggagtcttccagatgaccacctcggatggcacagtcgattccattatccaacagatggctgatacgatcacttccccccaaacgcactgagatattggggtaacgggcttgaaactcatgcaggctcggagcgatcacccagcgggcaacagacacaagcgcttcgatccgcaactttccgcgaggttctaccgagccccccttgagcgccccttccaattcgtcgatttcctgaaggatgacctgacacttggcgaaataggcctgtccatcctcggtcaaattcaagctacgcgtcgtgcgattgagcaaccgtacacccagatgacgctcaagatcggaaactcgctgtgatacccgcgccttgggcagcgctaacacatctgccgctcgggtgaagctgccagtctccaccactttggcaaaagtggtcatcgcggaaaacttatccatttaattgtcaaataaagttgaacagagattcattattttacatatatatcaacttttcgataccaattaaaattaacttcttttactaccaaactgaggcgaaaccctgttcaagttcctgaacggcactgacccggttaacccaagagagtacaccgaacatgatgaaatgcgatcccgtcaagggtacttgccagttgcctgacttcaagcctaccgaaaccgcagtccctgccatacgcaatggtgtagcggtccattacattggcgatccaatgtgttcctggtgttggggcatttcgcccacggtcagtaaggtgatggccttttgtgaagccgaaggtatcgagttctcaatgacgatgggagggctaagagcaggtggaggggatccttggaatacggctttcaaagacttcctgcacaacgaatggcgtcatatcgctcaagttacagggcaaccattcggctttactttgctggacgccgcccacttcgattatgacactgaacccgcatgccgggcagtcatgacggttcagttacttcaaaccagaaaaaacctggctccttcaatagcactgaaatttttctcagcaatacaacgcaagttctatgttgaagggaaagatcctaaggtcacggatttttatgcggatatttgtgcgagcatcggactggatttcgccgaatttcgaaacttgttcgagtattctgaagctcggcaagcggtgcaagaggcattcttacgttgccgccaatggagtgtgagttctttcccaacgttgttgcttgagagtaataacaagatggcacctcttgccactggctttgttacgacagagcaagtgctttctcgattgcggcaacggatctagccagattgaaaaaggatcaatagttgaggttattggcaaagtgcccgtggcgtggacgctttactcgactgtctaccctcagcgttcaagatcgcgtcatcggggggtgtcagcagtctgaatagttctaaggttatgacgaaaacgagcgaccgaacgggttcaatcatgtcctcttcacaagagtttacgcacgaagtagaaactgggctgcgagagcgtttttttcctatccctccacaaaaaatcgaggcttattatgagttatattcttcaggttgatttcccttataccggcccttggggcaatgaaatgacgaaagcaatggaaggtcttgcacgatcaattgccgaagagccgggccttatttggaagatctggactgtaaatgaaacaactaacgaggcgggaggaatctatttattcagcgatatttctgcggcgaaagcttatttggcgatgcatactgcgcgtctgaagagtttcggtattccccatgtaaatgggaagatatttttggtaaacgaagccctatcacagctcgatcgcgcgcccatttaatgatgagtgcatagctggctaaaccggtctcatccgctcagatcatgcagtcacccgattagccatacccataaatacaacgccaaaatcacgtgggtaagggaaagtgccaccttaccccactcctacaccagcgtcgtacagattactgaggaaaataatgtactaataaaacagtcgttccagccgcaagcggctactcttcattttattatcagcccaagcaagcagtcgcttctatttcaatgagaagttcaggtaatgctagtgcctgtacaccaataaatgaatttgccgcagggtctgcgccctcataaaaagccccgatttgtgcgcaaattgcggccaaattcgccggtgaatggttgaccacataggtccgtagacgtacaacatcagcaggcgtggccccggcatagcgcaggacttctttaagatttgccagaacttgctgagtttgcgccagtagatcctgccccccaactaactcgccattggcattccatgccacttgtccggcaatgtgcaacgtccgacccgatagctgttcaaccgcatgagaaaaaccgaatggcacactggggtacatcgtctcgggattgattacacgtctattcatgataactctccattattgatggaccgccgtaggtttacaaaacgacaaatacaaatcttaattaattaaaatatttttctctcatatattttaacttggctatctatatattttttgacaataatctaaatgtattatttatgcttcttacaattactttatacaaacgcccactcactggctagccgaaattcgatactaatcagcagtgggaattttatatactctgccattaaaatataaaaatggtagagttatcactgtgtttattttaatttaaaaaatcaaaccccagcaataacctctatttctaccaaggcaccttttggcaaagcagagacttcaaccgtagaacgtgcagggaaaatagttcctttaaaataatcagcataaatatcatttacttgagatgaattattgatattcgtgataaaaatagtcgtttttactattttatcttttgttgttccagcctgtagaagaacagcatcaatatttttcaatacctgacgagtttgtttttcaatgtcattttcaacaagatcccctgtatcaggattgatcggtatctgccctgaagcatacagaatcccattaaaacaaattgcttgagaataagggccaatagcggaaggtgcattttttgtttcaatgactgacttcatgatatatcctctattttaaataacgataaattgtctgctctgacgtttcaagacgcatcgccacctcagcaactgcccctttaagtaaaaaaacgcctttttcattaagttttttaacgatttcttttttctcgtccataatcaataacgaaggtgcacgagggtagttctttaaaacatctgtaatcaattcatgtaacatatccgttatggatgtattcctgagtacttcctcatcattcttattatcttcctcaataaacattaagtttccgataattttatgcgctagagataacgaagttaaatcaacattcatacagagcatcgcaataatttcaccctcttcatctttaatgaaaaaggttgaagcacggatattttctgatttcccaggaattctccctttgtaattaatgataaaatcacgttcttcccaagatttttcatggataagcttcaaagcaaaatctgtaatagtgccaccgatctggcgaccagttatatgattattttttatggccacaatggatttatctagatctcgtaaatcgtgcaatatcacctcacaattttcaccgtaggtgcgagcgataaactctaccattggtatccatgacttaataatttcatcctgggtcattgcaattctccacgtttatttatgatattcacaacgcactttttaatttaaaacccattaaaatggcgatattatttattatcataataacattttattattactttttgctagtgacgttagatttcaccttctaactttttgaaaaataatcattaagaccatttattcctgcgataagtacattatttttgatttcagcaacaagagcctctggggatggatgtgttgttgtaaaggacacgttccattgtataaaagttctattatcctgagtcacaggaataagttttatttctgcactgtatccatccaaaggaaatgagcttttcaatatagagtattcaagatgataattttttgggtctatattgactaataactcttcgacgtatccatcagacatttcaactcgccgaatactaccttgttgatcagcagcctgatgaagataaaaactacgaacagcaccaggatgataatctgaaaattcatcaaaagcgcttattttcttccagacttcttccacagaaacattgattacatcactaacagtgatacattccatcatgttaaccatccattaatttagggggagactcttgactaatgaaccatctttactttcaaagctacgcccccaaccaacgatgatcgagaatgacatcacgacgaaaagtgtcagaggatagaaagctgccagtgaaagatcaatggggttaactggttgaataaatggatattctttttgtaaagaactgatgatcgcactgactataaaaataaaagcactaaggaagggaatgatcgctgccagagtcatggcaaaacagtcaaccaggaccgcgcgacgataggggtgtaatgacttacgtaacccgatttcattagctacaggaccaaaagccaaaatagatgcgctggttacaccgccaactaatgcggttgcgataatggagccaatagcaatacaccattctgcgccttgagctgattgagccagtcgactactacagatagccgcagaaatacgatccatggttttactggcacgcagaataccaatgatgccgaacaaagaaaggacaaagagaatagtactgaccatctcatggaatccattgtacagaaaaccggtgacattcccgttatccagtgcaaatatatccgtgaagttaaaaataccggacagtaaaccgataattatccctgtgagtatccctgaagggatcgctttaaagatattacgagttttcatcgcaacaattaacagtaccgccataggaaccagcatccataaacttcggtaagatgcttgactatcgcggacaaggctgctttctgcgagaggtatattattggagcctaagaaataaaatagagctcccgcgatgatagcactgactatcgcaaatcgaaaacgcgcggcgactacacctgcaatttccgcgctacctggcttatgcttgtaagtttgggttgaggaggatgcaactgtggtatccgatattggggcaatattgtcgccaaaaatagcaccacacagaatagcactggctaatacaacaggatctgcccccagtaaaatgccggaaggataaaatacggggaaagcagtaaatagcgttcctaccgatgtccccgttgccgtggcgacaatacaaacagaaataaaagtaaataatgtaaaagcgccgccatgcaatcccagatgattcgccaacagggcaaaactatctgcaacaccggactgagcgatcattttcgcatacatgccgataattaataggattgtagcaatagtgacagccatttcactgccaataccttcagaaataacggctttccaataatgactaacattacgtgaaaagattgcccctatcataattgcaagaaatgcgagcatcgccaatgcggtcatgtcaaagacatggaaaactgaaaagaatagtgaacacgacacaataaaaagcagcatcggcagtaatgccatattttttccgccgcgaaaaatgagtccttcattatccatggcagatccccttttccttcgctaactgcattaatgcctgttggattcgagtcaaaactgcatagagtttttcatcatctttataacaaccatgtaccagacgaatatacccctcaccaccttgaccataaggaacacctgaattaaccatgacatgagcatgttgcaataaatagtcacagataaaggtagaggtacccagtttagaaatatctatccatgagaggaacccactttcaggcatcaccatgcatacgccaggaatcgcattcatcatctcaaacactaccttacggcggcgctcaaagatttgcgtatattcccccataaaagaaggttcatccaacgcagcgatcatgcccgcctgagaagaggtatttgtcgcacccacgacattgacggtacagccaaagagaacgtcaacaatttgggcatcggccaccagatatccaacgcggaacccacttaaccccatgcctttagagaaggagaatacactgaccgtccgttcccacatgccaggtaatgacgcgatagaaataaattcgatttcatcaaaaatagcgtcttcaaatgcctggtcgacaaccaatataagatcatgtgcgataataaaatcggcgatagcctgtaaactttcccggcgaagcactgttccggtaggattattagggttggtgaggatcaccatcttggttttttcggtgattttattttcaaaatctttaatatctatctggaaattattttccgcttttagctcgacactgatcggtttccctcccagtaattcgacgttaaggaaattactgggatacgaaggggaatgaatcagaacttcatcatcattattaataaaaggcatcatcgcgaataataaacccgaatcggagccgggggtaatcagaatatttcgctgtgcctcaacagtaaggttattataacgttgtaatttaagtgctattttttcttttaactctggattaccaataggcattgtataatggctagcactgccattttccatcgatttaatcactgcttgagagatatgttccggcaaaacggggtcggggaaaaaaggatctgcccagcacaacatgtcaacaccattggccatgagatccaatacagcggtaccaacatccgctttttttacactgctaaacaatccaccttgtaagccttggaactctggacgcatttttcttctaatcgtattcatggtattcccctttaataaataaaaaattatttctgcaaatcacaggcttactaaatcaaattaataataattaatcaacgtgataattttttattaaccaagatcgtgatgataaacacacttccaacacattaagtcgcgatgggggagcatgccaaattggatataactcgttgaattttattttttttataattaacaatcagtcagttgacacaaaattctctctaacagcggaatttccataggacattgtcataattcactgttgctatcccctatatttccaaaaatgagtgccaagggtttatgtattaaataggtaaaataagaatacaaattgttaaatttagttgaaattattttgctgaaagagtgacttcagctatttacgacgtaatacctactaccgttttccagtgaataatagcgtcagggggggcttctccgccgtttaaggccagcggtcagtgagtgatgcggcattgaaccctgggaatatggagtcgctttttggtgttgtcttcatgggattgacgaagagacgtgtaatctcgttatctttcgccggtagatgaattgaaggaggggcgttttactgctattccgggttaacttttgtcataaaaataagttgttacgaaagaatttgttctatgctcaagagtgtacccgcagggaggtcacggtgatgatgaatgttgtcccttctctgacccaagaaatcctttccccaataaatagggtgtcgtggaaaataacacactggctaacctgacgctgctagagggtcatcctctggaggatcgccaactcgttacccagacagagaaagcatttcggttaatcatgaatcaaaaacattctgggaagtgttcagtagcggttgtttatgatgatgaacccagctttctggtcgggtttagcgcgttaattgaggctgttcaatgaataatatgacttctctcaggaagctgcggtggtttttctgcacgtgtttaacgacagcaaaacaggcgctatggcgtgggccattgatcctgttatcggctatagcgctgagtggctgctcaggggccgaggccccctcattttcggtagtgggctcctatttcccttactggatggcttgcgcttttatcgggataatcaccgcggtgattgctcgcgttctgtttattcgcgttggtattgatgaggtgctgccatggcggctgttggtgtatgtctgcctggcgcttgctgtggcattcatctgttccctattactgtttacgcgatgaataattcatatgaataaacaacaagggagtggtcgtaagcggcaactggcgttaattgtcgccggggtcatcattattgccgccgcgatttcagggtggctttcagtgcggcagaccacactgaacccgctgtctgaggatgcggagttgggggcgagtgtagtgcatattgccagctcggttcctggccgtatcatttcgatcaatgtcgaggaaaatagcaaagtccggcgtggtgacttactgttttccattgagccagatctctaccgtctgcaagtcgaacaagcgcaggctgagttgaaaatggcagaggctgcccacgatacccaacaacggacagtggtcgcggaacgatccaacgccgcgatcaccaatgagcagattgtacgggcgcaagccaatctcaaattagccactcagacattggcgcggttacaacctttgcgccctaaaggctatgtcaccgcccagcaggtagatgatgcagcaacagcgaaacacgatgcggaagtgagtcttaaacaggcattaaaacagtcagtggccgctgaagccttggtcagcagcacggcgtcttctgaagcgctggtggtagcgcgccgtgcagcccttgccattgccgaacgggaactggctaatacgcaaatacacgcgcctaatgatggtcgggtcgtcgggttgactgtttccgcaggggaatttgtcgccccggatcaggctattttcacccttatcaataccgaacattggcatgcttcggcatttttccgtgaaacagagttgaaacatatcaaggtgggtgattgtgccaccgtgtatgtcatggcagataggcagcgggcgattcaaggacgggtcgaagggattggttggggggttagctccgaggatatgctaaatattccgcgcggcctgccttatgtgccgaagtcattaaactgggtgcgtgttgttcagcgtttcccggtgaggatcagcctggaaaaaccgccggaggacctgatgcgtatcggggcgactgctgtggttatcgtgcgaaatgacgacggttgctgacggtacgcttggcggcataatccgtcaggcgaaagctgacttagcctttttcccagggcgggtggcgatggcgtggcgtgttgccgtgctatgtgcattgatggcgatgatcgccatgatatacggcatccctgaatctgcgattagttgctatctcattatttttgttatgaagccggatggtgtagagagcatggtgatggccgtggcgataacgatcctggtgtcgttggtcgtcgggttggtatttctgcttatccatttcaccctagaggccgcaccactgcgcatggcggccttgattgtcagctcgtttctctttctctatctcggatcggccagtaagctcggcccggtagggagtattattgcgctggttatcgcttatgtgatgacgttactgagcaatatcccaatgggagatgtggccacgcgggggctgttgtatgcctggttgatggctgtttcaccgatgttgctgattattgggtttaaccttttctttggccgagcaccacagacgttattgcgggccagcttagcggagcggttatccacggtcgccgagacattacggcaccccaatgccgccaatatggcgcgggttggagaacagctacaggaagggcaacatgagcatcaacagcgggcgctttttgttcgtatctttcatctacggccctcggctgaagcggcctggcttgaaagtgccgtaaaaagcagttaccggctactcttggtaacctcggcgttacctcctacctcaccagaggccgtgcgccttgagcttgcggcctactgtagtgatgcggctcaggcgattgccagcggtgatctcgcggccccccctcacttcgcgattgaggataccagcgatgaaatcaatgaaatcagaaacgcgctgatcgcactggcaaatgcggataatgggcaagacctggacgccccgaaatcctcattctttgcagcagacgcattgactaaccctgttcatcagcagtttgccctgaaaaccaccgccgcggctctgatttgctacctgatctacaccgcactggattggcaggacattcatactgccatgatcacttgctatgttgccgcactcggtacaacaggtgagacggttcataaactggtcttgcggattatagggtgtctgatcggggcattgatgggggtactgtcgattattttcattattccccacatgagtgatatcgggcaattaatggcgctggtatttggctgcattctagtggccgcttgggtgtcatgtggcagcgaacgtatcgcgtatgctggcgtacaggttgggttggccttcctgcttaccgtgctgcaaggttttgggccaagtaccgatatgggtgtcgcactcgatagggtgctgggtatcttgctgggtaatctggtggtgtacttgatttttagccggctgtggccagtcgcgattaccgatgcggtgcatgtacatattagtcgcgccttgaaggggctgacaaatttagccgcgctctcgccggatgcccggcctgcagcgctcagagaggccacaactgtcgaggcggagattaccaaggcgcaggaagagttggcgctaattccctttgagccagtacaatttcgcccctcacggaaagagtgcgcacgcctacaggccatcttggcagaaatgggcaaattgtgccctgttctgtttctacccacggaaaagtcagcgtctgatgtggaacaactgcgccagctctcggctgggagcgatgccatgacattatcggatgagcaaggacagaatagcgggtctttacggcaagagttatcacctattaatcttataattcaacaacgtataaagcggcttgaggaacttctgggaatttaatgacatgatgacgcacgcagtattgactgcccggatagccaaaataagcctgacttgctcgatattgagttggagcctgttgatcgtaggttgtgctacagatcgcttggatcttgcacctgcatcttacaccgaaccctggacgccagatgggaatgcaagggcttccatggggggcggtaacttttctgtgccaccgaatccgatcgtggccgaattagcccaaccgccgaccataaaaagtgatcatgcttattcattgccagaattgattgatatcgcccaacgtcagaatccggatacccgcattgcctggcagcaagcgcgacaggcagcccttgcggtaggaatgggggaggcgatatttttaccgatcatttctgccagtgtcattggtggctaccagcgtacgaccacacctctgccttatgctatcggcaacgaaaaggatctgaaaacaaccgggagcgcggttattcctgctttggccttacagtggcttatctttgatttcggccagcgcagcgcgttgcttgacgccgctaaacagacgtcttatgccgctaatgtgaccttcaatggcatgcaccagaagctgatctacgatgtgacacgcacttacttccaatatggtgcagcacaagcccagagccagatagcaaaacaaacgttgcaaaacagtctaaagattcaggatgctgccgaggagcgccagaaaaagggtattgcgacaacggttgaagtggcgttggcacgccagcaagtcgcacagtctcagttgcgtcgtgtggtggcaaaaggtactgaacgtgatgcttatcaggcattattaggagcgatgggcgtttctccgtcattggatatcaaagccgcctataccgaagatcgtgctttaccagatgggataagcgccccgacagaaaagatgatccagttggccctctcccagcggccagatgttttagccagctatgcggcggtcgaggcagccaaggcgggtatcaaagccactgaagccgatttcttgccaaaagtctatctggccggggcggttgctggtggtgatgggcattttgatattcagggcctaccgggtatcagcccgcaaacttcatcctctagcattttagtcggtgtcagtgttcctctgtacgatggcgggatacgcgcagccagagttaaagaggcagaatcccgcgctgctgttgctgctgaaggatttaagaaaacgcaggaattggcggtgcgcgaaattgtggtagcagcagatacattacgctctgcgctcgaatccaatcaggcggcattaaatctcgtgaagacctcgtttatctcctatgatgcggcgctggagtcttatcgcagtggtgttggcaccataacggtcgccaatgaggcggcaaatggtttgttgaatgctcaacaaatgagtactgatgcacatgccgcctctttggtcgccgccgccaatctggctttcgtcatgggtaaaatgaccaacacctcaccgcctttggaactgcttcattagagagtgaatggccccaattccattaggtatcctcttacctctcaaaatggggcctctctattttcaaacagtgtaaagattttcaaacagcgtaaaatccgcctgatgtggcgtcgttgagtcgccaccgacaaatacgctgatacgcgacggctcctgcgcatagcggcgatgttggccgtaaaatgccagctcgcgcactcccagcgtgaagctgacctcgcccgattcccccggctgcaggctgatacgttggaaacctttcagttcacgctgtggccgcgtggtgctggcgacgtactggcgaatatagcactgtacaacctcatccccagccactgcaccatcgttggtgacggtcattgtcacccgtagcgatgctcccagttcgagtgattcatggctcaactgcaaatcgctataggtaaatcgggtataactcaggccaaaaccaaagggatacagcggtgtatccgccagatctttatagggctgatattcacgatagtcgcgcattttacccagtggcttgcggccataataaatcgggatctgaccggtactacgtggcaccgtcatcggcaatttgccacagggaacctgttcgccgaaaataatgcgagcgatcgctttacccgcttcactaccgcactgccagccatataacagcgcatcggcgtactgctcggttgctggtgatggcaacgggcggccagtgcactggattaccaccagcggtttaccggtgcgcccgaccgcagcgatcaactcttcctgtcccggcggtagctgaagttcggcgatattgcgcgcttcgccggtgcggcggtggctctcgccggtacagagaataacgatatcggcccgatgggcacattcgatcatctcatcgctaaaacaactctgctcggtgatcaccttaacctcccctgcgatagcgcagagggattgatagatcgacatcacttggtcggcgtcgccgtccagacaccaggagccaagatgctggcgctgcgaatgggcgtgtgggccgatcaccgccagcgtcagcggtacggatgttctggagattggcagcagcgcctgccggtttttcagcagtacgatcgactgctctgccaaccgctgtgccagagccagatgctcaggacggcgcagctcgcgcttatgccactcttcatcaacataagggcgctcaaacaggccacagcggaacttggcgcgtagcacccgacgcactgcgtcatccagcaacgcttccttgatccgcccctgtaacaccagttgatccagcttatcttcataggcctcatgggtcatggccatatcgacaccggcctgcagcgccaattctgctgctctcagtgcatcttgagcaataccaaagtgagtcagatccgcaatcgaaccccaatcgctgatcaccaggccgtcaaagttctgctgctgtttcagccaaccgcgtatcagttcaccatgtgcagtgaccggcgtaccgccgagatcgcaaaaaccggtcatcaccgagccaacgcctgcctctatcgccgcttggaatggcggcagatgcacattgtgcagcgtgttgtcggacagctcggtggtatcgtagtcgcggcccccctccacggcggcatagccgacaaagtgcttggcacaagccatcaggctatcggcggcgctgagatcgtccccttgaaatcctttgacgacagcggcggcgaactgcgcggtgagccagggatcttccccgctggtttcgatggttcgcccccagcgcggatcgcgcgcaatatccagcatcggggcgaaggtccagtggatacctaacgaagccgcctcgcgggcgataacgcggtaggcctgctgtaccagctcggggttccaggaagccgcctgcgccaggggtatcggcagcaccgtcgcctgcccgtaaatcacgtcacgggcaaacaacagcggaatacccaggcggctgtgctctacggcggcacgttggatttcatttaactggcacggatcgacgttttctcctggcgcattgcccgcccaggcggtatcagccagaatgcgtgaaccccagcggccagcgcgtaccccggcaagatagtcgtcacggtgttgctgatagtccagcatcggctgttgacacagttggcccactttctccgccaacgtcatctggctgagcaaatcgtcaattctagcctcaatgggcagagtggcatcgcgataaacagtactcatagtgttctccaaatcaggtaatctcccgatcactctgccgcatggcggggttagctatcggtattgcagccagcatcgagctgcgaagaggtgcgcaaggcatgggcgggaaatgcctcggccagatattcctccatcgtccgctggcttgcgctctcaccacgctgccggtagcgagccagcaggcaagttgccgcttcggcaacgaagcgggtatcaatttcggtgtaggtagcaataaactcggccagttgctgatcgctggcccgagccaatagatcgctgctacgcgccagtgcctggtggtagaaatccggtcgataaaccagcatgccgtgacgccagtcgtcgatcacttgctgatagccgccagaatagacatcgtggcggtacagctcgatcttgttcatccccttcagcgccaggatataatcccctgcggcatatcgctgttcggcgaagtcaaaatagcgtttggactgctgatagaccatcagccacgcgctgagataggccagcagaataatcagcaccagcgcaaagaaccctttctttccactcatcatttcactccgataccggtgaacgccttgataaaattgcgctgtaggaaaaagaacactagcaccacgggcacggcgatcatggtggtcatcgcccacaattgctcaaggttatcggtagggatatcgttaacaaacttgaacagcgccagttgtaatgtcatcagtgaatcgtcgcggacatacaacagcggccccataaagtcgttccatgaccccataaatgtgaggatcgcgacagtggcaagagcaggccggatcatcggcaacaccaccttgaaaaaaatggtgaattcacctgcgccatcgatcctggcagcttcgagataggcgttatccacctgttttaaaaactgtaccagtaagaagatgttgtaggcgctaatggtgccgggcacgatcaatgcctgaaaagtattcacccaaccccatgagtacaacatcatgtaggtaggtatggtgaacagcaccgtaggcaccatcattgaggtcagaatgagtttgatccagaactcgcggccagggagattcattttgacgatggcgtaggccaccatggccgaaagtagcgtattgaccaaagtcacggtaacggaaataaacagagtattgaggaaaatacgccccaaattcaggctataaaaggcttgaatatagccattgaacgaaaagttcttcggcagagcgttaggggcattgatgatttccgagccagttttaaacgaattcatgatcataaagaaaaacggatacagcacgatcaggctgatgatgatcaacaggctataaatcaacagattttttttgctgatgcgcattagctgtgctccttttcctgagtaaatttcaattgcagcatggtgaaaatatagataaccgcagccagcagcaggccaatggttgaggcggtgcccatcttcatatccgagaaaccggttttatacagatagagtaccggtgtcagggccgcgttataggggccaccgtgaagatcgaagttcatcagcacttcaataaacatctgcataccgttaataatattcatcgtcatgacaaagataatctgtggtttcagcaggggtagcgtaatgctccaggttttccggcgccaggaagcaccatcaatatcagccgcctcatacagcgacttactgatcccggcaatgccgcccaaaaagatgatcatttggataccaaaccacttccaggtgctgaatacggcgatcagcggcatcggcaaccagcgctcgaacttccagaacactggcgcgtcgagcactccccattccaacagcaaactctgtaccggccctgcagggctggagagaaaattaaagataatcatcgccacggtgatcgaagtgataaccggaataaacatgatggtgcggaacaagccgccgaagtgggtgatttcgtgcagcaacagcgccatacccattgccagtacgaaactgagtaggacaaagatgacttggttaaagatcacgttgaacaacgaacgccaaaatagcccgtcgctagaaacgctaatccagttgttcaagccaacaaattgggtactctctgggctcaatacgttgatatccagaaagctgttctgaaaagagagaaaaaagggatataaaataaaaaccaggaaataaataatccagggcgcaataaacaggtagcccatcatcacatttttatttttcacatcggctccttaagggaatacctgcatcgataccgggtcgctgcgtgcatggctcagtgttcattgagcagttggcgtgcggcctgtgccgaggtggcaaccgcttgttccggggatatttcccctttcagtaccactttgctgtagttggcgagaataatattcgccacctccatcgcattggcgaaaggctcactcaggatcgcatgttgtagttgctgtacgaacggctgtgcctctgcggactgaaaatagggagcatcttgcagcgccttcaacgtagggagctgacccagggcaatattggcctgtagattgatatcgtcgcgcataagtaggttgagcagcgcccaactgagttgctctttcctggcctcatccttgaaaatcatgatggcccgaccatccaataccgagtagtggatgtcgcccttggtttgtaccgggatcggggcgatggccacgtcctggcctaccaccattgggcgttcagccgccgacgagagggtggccttccagccgaagccgaattgtagccacatgccgatattacgggagaagaagcttttttccatggtcagtggcgcaaagcgctgcgcctgctgcatggtacgcataaactgcgccatgttggcgtcgggacggtcgaatacgatgtcggtaccgtagcggtttagcaactgatactggccctgattaacgttgtaatacatgggtgtcagcagattccagtaccaactgccgaatgacagcacatcattccagaataccgtgccgtagactttgctaccgtctgagcgagggggcaaggcggagatcttttcggccgccagtaaaaattcatcccaggtcgctggaggacgctcaggatccaagcctgcctcagcaaatagctccttattataaatcatcatctgggtggtggcgttccacggaatataataggtacggccaaagttttcacgtaagaagtgaggatcgatacgttcatttaattcggcaaaaccggggaatttatccaaatacgccagcttgccaagcttcgccagtttggcgggttgatagccgaatacaccgatgtaaacattggggttatccccggcggccattcgggtatccagttgttcgtcattggataccactaaattaacctcgggatagagcttattaaattcaggggtgacggtattacgcataaaagaaacatagctgccgctgggcaccataatttctagcctttcggccgccataagcggcagcgaggctatcgcgatggcaatataataaagtatcttcatattattgattaatcctgaagcgcggatatttggcaattgccattatttatctcgcgctatggcaaatagtcggccgctatagcgtctctctttcaatcaactcggttggtaataaggtcaccgcgtcaatatcggtttcttcttttattgccctcagcagcgtgttggctgaaataacgcccatctcatatttatgatgattgatggtggtcaacgacggggttaatacacctgaagcataaatattatcgaatccaaccacttttagatcgtccggcacgcgaatattatgctcttttgctgcacgtagaataccgatggccatctcatcattagccgagaaaatagctgaggggacccggcctgcagcaatcagcgcctgcatttttaaataggcatccgcttcggtaaaattagagtggataataaagtcgcggttgagttgtatattgtgatagcccagcgctgcaataaaaccgtccagacgtttctggttatcgtaagactgttcggggccgctgaagaaatagatatcccggcagcctttcgccaatagagcgttgacggccttgaaggcaccaccaaagttatcgatcaagacgttataaatgtgcgggctcttcagttcacgatccagtacgacaatgggcagaacatcggaagcaacggattgcaggaagcgatcatcgaaagagctggtgagtataatggcgccgtccaccgagcgatctctaaggtatttgtgagccgtagactgttcgccgccatacaggctgcaggcgactaaatcgtagtgctcacggtgcactctctcctcgatgccgcgcaccagttcgctatagacaggaccaaaccatgagttgaagaagagcccgatggcaccactcttcttagcctttagcatcttggcgttgttgttggcggtatagttcatctcttgtgctattttcagcacccgcagccgcgtctcctccgtgatcttcggactgccattaatggcataggagacggtagagatggaaactttggcccttttagcaacatccttaatcgttacactcacggctaactctctaaataaaaaaggaatttactatagcatgagccactcaggcttttgtagcgccacacttcagtgtggcacattcggcccggtggctcagccccgtgactacaggtaaatctctagctgactgtgtgccgtcagacgcccttcaatctcctggcggtgaatcagtgcggccccactacgatagggattatcctgcaacgtaaacgccagcggctgaccatcgagtagcacacgcttcggggtaaactccccctgttgtggatagatgcgcagcgtgaccggaaggttatagagttgatagtttagcgtcacatcaccaaactgccgactgatcaccggatccagcaacagatcgccggcctgataacgcacaccaagtacgttggaaacgatctggttgatatagatcccagggccgctggagtaaatacgccagcccgctttcgcggctacggcaccggttttcaattgatcgaagttgttataagcctggtagcgatcatcaaacttggcatcggaactggagaagtagctgtttgcctggcgcagctcggcgttaggcacgctctcctggatccccacagggatggttttaaacaggttatcgtacagctcctgcgccatccccattttgcagagtgcttctataaagcgaatatgggcgtggcagtattgtaggccgatttcacgccccagattagcggacagttcggcccgtttgaagtaagtctgcttaccggccttgtactccgccatccggtccatcaggcgcacgccatcaggatacattaggttatccatgatgatcttcatgtgctgctcggccatctctttatcgaacgactcggagataattgagcgcttggcgggcaacagccggtacttgatctgggtcgtggtatcggtaggatgcagtaggtattccgcctccccctgattaaagtgaataaagccgctgatcacgccgtccttgatcaaatacttatggtaatccgcctccatgttgctggttagcgtcacgatacgcgcgataaaatcggcaaactgcggataagcctgtagcgccttggtcaaggttttcagcgtttgcagcgtcagcggaatagtccagccactgaccatattttcccgcagcgactgattggcgggctgcaacgtatcatcccagtcaccgtcaccgtagctggaaagataggtaccgggtaccagatgcgcaacgatatggtctatctgccgctgaacatgttgcagcagcgtctcctgctcgccggtaaaggcgaaattctgtttgatgctggtgtaggacagacgcgtgtccaataacgcgacgcgatccgtggctaacagataatcggccaacgctttcagcggccagaccacaatatcgccgtgcgattcctgctgttgtacctgagcatattcatcaaacataaaccactgcggccaggttccggtttccagatactgatggcgataagtctggcacagaatcgcttcaacctgctgatagcgccccatggccatgaagaactctatcggcccctgtgaaacgtcgcgggtcccccaagcggcaccggctggctgctctaaaccatgcggtgaactgtagtgggtgagcgcattatgggtgaaccagtgcatggcgtgattcagcttctgcgcttgctgcggtgcagcagaaaaactcaccgagaagtcgtttagcagtgcacgatactgtgcgtgataagcctgccgctcgtgttcaaaatccagccactttccgcggctatctacgccgtttagcacgccaccgaaggcgatgctggcctgctgggcaatctgtccttgtagcaacaggtactgtaccccttggctgtcgctatcgacgtatctttcgacacccgtgaacccgccgcgagtggcgatgctaaagcgggggccatgatcatcgcccgtgcggctgatctgcagcagatcgccatggcgttcaacctgtacggtcgcttcctcctccagattgcccatgatcagttggtggctgacaataacgttgagcggttggctatggcctgagacagcaatatccaattgaataaccggctcactctggctggcgaaggcgcggacctgaatcatgccctcggccagcttgtatatccagcgagagaagttggcacccacttcatatgcagagggcatcgccagaatgcgatattcgccgccgatctgtaccagaatgcgctgaccactgctcttgaactgattgagcatattacgattaacgcccagcagcttattaaaggaggtgttacccagcgtcagatgcgagttgaataccccatagatatagtgggtagaattcatgatgggattagtgaagtcgatattattgccagaggaaataatatggccggtcggtcgctccagatggcgctctttttctgccaacgtgacgtagttagcctcctgatagaaaaacgatagcagttcaccgtccaactgctcaacaaactgtttttcaccgtcaaacagttgttcgatctcttctgccgttagcttatctcccgacagtggccgctgatcatagccctgctgagttggggatgcctgctcggtagcgggttctcgctgtggctggcgatagttagcccggatccgcgcaacatcaaaggcctgtacaatattggcctctggctggtggctgagatagaaaccgtaaaatacgctgtctgcgctgtcacccgcgggcagcgtgactggctgtagctgtagagcgacataggccatttcatactggtagttccggttctccagcgatggttcagtgacgatggtgggcaagtggctaaacttgtactgcttggcaaagaactggtaaccatcggtagagaaacccactgcgggtgagaagctaccgagttgtagcaggggattaccggtgctctgtggtaggttttgccgagaggatacggtatagccatacttatccagcgagaagaccttatgatccagatactgactgcagtaggattcattggtcttggtcgcaccggcatcggacagtgagagatcctgaccgtagatcagatcatagcgtagcgcctgcgcgctgtgattttcaacccgcacactgtagtagtaagtctcttcctgctcatggctaaaggagagagtcacaaaggcagtgaagtctggagccgtggtctgccagatgatttcatcctgcgcgttcttataggtgacgagttggtcattgtgaaacaacagtggggtaacccgcacaataccgctatcgtccaactggcgcaggaagatattggcaatcgccatatccagccttggggtgtcaaacaggttgagcatgatgtcgccggccagcatgtttttcaacatgttgccctgcatgaaattaaactgcagtacgccgccctgtgcgctgtgtacgacgttggtgattgacttggttatcatttaacttgccctgaagataattaaatatatatccgaattccttcaagctgcgggagttaactcacctgcaacttaaaattaattagatatagagaatatttttttcgctttctttatcgaaaagatggcacttatccagattaaaagagaaatggcaggtctcattgatttggatttcatcttcaggattaggccgtttacagatagcctgctgccccatcaagttaaagtagataaactcatcggaacccatcgcatcgactctgataaccgtggcagttagcgcattggctacgtctgcgcgactgatgctgatatcctcaggcctgatcccaaaatcgatctcccggcccagataagaccgactcttagcgactttatccgccggcagtggaaagcgatattcgccacagcgaataaccaattgctcttggtattcctctatgcgaccgctaaacatgttcatggctggcgaccccacaaactccgcaacaaatttattgagcggatggcgatagacgttcattggccggtcaacctgcatgatcttccccttgcgcaggatacagacgcgttcacccatggtcatcgcctcaacctgatcgtgagtgacgtaaatcatcgtggccggtctacccgattcgcgtagttgttgatgcaacttactgatacgcaggcgcatggagacgcgcagcttggcatctaggttggacaggggttcatcgaataaaaataccgcaggttttctgaccatggcccgacctaacgccacacgttggcactggccgcctgacatctctttcggcttgcgctgcagcagatccgtgatttccagtaactcggcggcctcattgactcgctgagcgatttcagctttggtcttcttcgccaccttcaggccaaacgccatattttcgtacacggtcatatgcggatagagggcatagttttgaaataccatggcaatgccgcgatctttaggctgcacgtcattacattttctgtccgcgatagtgagctcaccgctggatatttcttcaaggccagcaatcatgcgcaacatcgttgattttgcgcagccagaggggccaacgatcaccatgaattcaccgtctttaatatccaaattaatatcatgcagaacctgcatgccgtttggatatattttattgacgttatgtaacatcactcctgtcatcacccactctcaccgctcaatagaaacgtttcactagattagagtttgccatgggccactgtcaatatcgcgcgacatactgacattccgttacgagatctctatcacgttttgacatcacttcattcttaattcaagaaaaaacatgcagttatattgggatcgccataaagttatcactaaatgtaataaaatgttttgtatgtcacacttttcaataaatctctgttaatgcggttgactcacgttgtttattacgcagattatagaaacgtttctattgaatggtttttaacctaaagtcaggcttataaggcatatttacatgattaataaaagaaaaattgtcctcgccgctatattactcacggttaacggcggcttgttcgcccagagcgtcgtgattgatcaattaaaagtttctgagcatctttatccaaagggatttgaatccgaatttcagaataacctcgatttctatcgtgacggtgttggtgtcgatgagaaggccaaagtgccttacgatacgatccgtattgaaggtactgaaattgttaaaggttattataccaacaccaccgaggtggggttgtatctcaatatattaaccgagtcggtaaaagccggtaacctgcaggcgttacaacgaattaaagagacattaaccaccttggagcaggcccccaaatggaacgggttattttactggccctatgatatccgcgacggcaagctggtgaccaatcccgatgaaatcgtacctgcggtggataacggtaatctctcgttcgcactggcgggggttgcgggtgcatttctagattcgagcgatgcggacaagcaagagatcgtgcaacgcattgaggcgatactggacggacagaaaccaggctgggccgccctgtacgatgaaaataaaggtctgctctcctctggttggtcgacaaaaaacaatgcgtcactgggctacttcgttgatcgcaagggcaatgaaagccgtgcggcggtggcctgggcggtgctggcgactaaagatatgggagccaaagcattaccggttagcgcgttcagtaaaatggagctctacacccaacgctatgaaataaacggcaagcaatacaacccgctgctgacctgggatggcgcttatttccagatgatgatgccgcaaatatggctgaatgagcgtgaactgatgcctaactacggcattgtcgaggatcacacctttattcaaaaagtctatgccagcaagcatggcattccaatggtttcttcctccgctaccacggataacgcttaccacgccttcggtgtgccacagctttccgagagcaaagttcgcttcaagaataagatcgatgatggctataccggtacgccgcacgcaatagcgctctcctatatcgtcgatcctgccggagcgatcagcgcattaaagaaactgaaacaggcttatccgaatatcgaatccccgtatggctggtatgacgctgtcgatagcaacggcaagatctcaaaaaatatcctttcccttgatgtcggcatgtttgttggtgcttttctggcgaaagagatcaatgccgatgttgaaaaatacctacaaagcaagggcgatatggaactgctaaaagagatgtatcagtcctacgttcccaataattacaaaccattggatggtctctccagctcttctctgcactgatgactaccgacacctaattaccctaatgccacctctcggttcaccagagtagaggatggcattgccccccatttcgcgatgatagaataaggattacaggcatgaagagattgttactgtcggcgctgttgatcacacctggcacgttgctggcagccgatgctcaggagctcccgctgctcagtggcggtgatacgccgaccatcaagaactccaacctcgatttgttcggcgtttccagagacttcggcgatattatatttatcgacgatgaccggacagtgaacgattccgcaccgaaaagaacccgcgtttttaccgggtatgagtatgaaaatatcaagttctccaatcacccggcgcaactgtatagcacactggtattcgctgacggttcgaccaagattaccgacagttttagcatgggttatgtgctacgtgagactacgatttacgacggcccacgtaataatgcatttgccggctccgataaatcgcgccgtgactcttttatggaaattcagttgctgccgaaatatatcaactgggttaacgagaatttgagttacggtgccgaattgggttacgagcgttttactgatgccaaagatgcgccagaaaagcagatgtaccatattcgcccagagatcaatctgggatttggccgtaatttcctgcatctcaatgccgagttgggctggatagacagaactgaccgcggcgcttatatcgaaaccgaaccactgtatctctaccgcgttaccgataactttaacattggcgcaaaggcctattaccacgctgaagataacgactatcgctggcgcgagacggcaattcgcccgttgatacagtatcgcttcgccaacagtacctatctggaactgcgctgggagatcggtggtattcgtactcatgacggcagtggttataactacaacaattacggtttatataccgaaatccccttcaacccgacgatatcctttatggccgacctgcaatataaggatcaaaaacagcatcggggtaatgaatggtcgtggggcgataaagaagatattttcgccaaagtcggctttatccttaatttctaagcggccacatccttttactaacgataaaaaatattgggctaatatttagggaatgacctatgaataaccataagatctggcgtttatccgccgttgctgttgctttactgattagcggtaatggctatgccgatcagaccttccacttcgctcagcaaccgcataacacgggcgatcatactgtgatcgccgcaccagaggtcaataacttttcattggcagatctgaccgccaacgcagaagggcaagcagtggatgcgaccaacgcaggcgcactgtcgctgcgggttgaacccactcaaggtgacgctcaggcgaatggcgtactggtcacctccggtacctttactaatcaggctcagggctcgattaccgtgagtgccagcagtcaggatcaacatgctgttgccagcgggttgcaggcaacggatgcctattggtccactctgcgtaatcagggtagcatccgtgccacgagcaacagcctacacggcagtgccgaggcctatggtatccaggctggcctggccttttccgatgccgccggggatcactacggtgaccacatgatgttgagcaacgagggtgtgatgcaggtgagtgccacggccgagcaggacgcctttgccagcggtatctataccaatgccggtaatggcgtggtcaacaatggccgtctggatgtcagtgctcatgccagtgctggcgatgcacgggcaaccggcctgcataccctctctgccaacccaggcgtcgatcccgatccatggaaccccgctaaccccactcatctgatgagcaacaatggctcgttgtcagtcacggccagcggtaacaatgcgaccgcaagcgcgatcagtaccgagggcgaaggggtctacatctacaacaacgggacactgatcgttgatgcatttagcgagagtgcgcagggcagtgcatccgcctatggtattcatgtgctcaacggcagtgccacgatcaactccagcggcagaattttggcgacagccaccggcggaagccaacagcaagcctatgaagtgatggccgacggttcggtagttaatattgaacgctatacactcgccttgggcaatgagacaccgtgggcggtcagtaatggcggttcgatcgtgctgggtaacggtacgcaaggggccgatctggtgctaatggctgggcaggccagtgaaggtttcgcctatggtaaagagtacagcttggacaatctggcttacgataccacctccggccagcagagtacggtggggggttctattgcggggttgtacggtattacgcctgatatcaaggtgattcacagcggtagcagcagtagttcgttgggatctgctgcactggtgtatgcaccggatgtctctcatgccggagtctccgcattggcacagcgttcttccatggagcaggcatccaatattatctcctcgcaactgcatagtcagttggtaagtaacgccggttgtaaccagaagttggagagtgccgatagctgcgtctttatcacaccttatgctggtgagtaccgtcgtgatccagtgacctccggttacagcggtcagcgctatggggtattgctcggtcagaaccaacattttggcgatttccagcttggctggcacggcggttatgagagtgccagcaccgattttaatggtacctctgtagggcgtaaggaagagatcaatacgctgatgctgggggttcagggcggaatgaagctctctgagagtctgtttattgcagcgaccagtacgtggttcagcagtgacaccgattacagtgacagcaatacctactacggcgtgggtagccagagcggcagctatgatagcagcggcctctacaccgatgtctccgtgggtaatagctggcagttgaatcgcaactatgccatgacgccgatggtcgggctgacgcatatctggcagcaacgcgatggctatattgtctcatccaataacagcaactatgatcttatcgacacccgctatagcagctacagcgaccatgcagtcgctctccatgctggagtacgtctcgatggtcgctatccactgaccaacgagacactacttaagccgttctttaatgtcggattgcagcaaatgttgtatggcgatgagatcaccatcgatcagagtatccctaattcgccggtagttggcgtaagcaccaaggataaaaccactcaaggaaccttcgatctggggatggcactggtaagcgataacggtgtgtctgccagcctacagctatcgggcatggtcaatagtgatcgtcaggatttcaccggctgggcaaatctgggctgggcgttctagaggggcagttgcgttaagatgctgtcgtataacatgcagttcagcatcttaggccgctgacggcattcctaccgctgtactccgagtgcagcggcgggagcttgcttttgtatctgccaagttgataacaacattctttgtttgaccgttattcacgttctctcaatctcggtcataaatattacgaactgagtttgttttaggatcgatattattgaacacttcaccattaattttatagtctggatttttagtcagagaactctattaagcggcaagacgaaatttgggaggagtacaatagaggttcagcgccgcggtatggcgcttgcttgaggatccaccggtaacagacaggctgtcggtggccgcgctgagagtaatattctgcgcctgcacatcgatggtaccggcattcacccgcgcccccacggcggtcagattgtctacgttggcgcttagcgcaccaccgaccttcacctcgctgcccagatggcggagagagccactggtcgcactgccgccgccatactgcgcactgatctggtcgctacgttgcaccgtactgagaagccagtcgccaccggtgttcacctggagatccttgccaatattgatgcccgcgccctgctggataaaatcgcgttgggttttggcagtgatactcaatgtgtactgggtgttcaggcgctcccttaacctcgtacccacaaccgatgccccgcaacttgcctttaaatatttttatatttttctggaagaaattcctgccgttcaatgagttttatcaacttaataagctcttccttataaaaaaagagttcctgtttatcaccgcaccccgttattcgaaaaatttcctgatctgtgcaatgggttaatacgtaatcaatacatccttcatataccattagctcaccttcggaagttctcaggtcaaacaacgttacactggcaatacattctttctgtaataaatccatcacatcaccattttatatagtctgagaatttctgtttaaactgctctaactgttcgttagaaagataattccattcacctcttctcacacgagaatcagtattagctttaggattatagaaagaagtaacaacctcaccatccgactcaataatatgaatttttcccccactaccttttacaacccaacggccatcatcttgcactaaaatatctgctggtcgagatttttgaacatcattaattacggcaccgaccgggcgaccttcagtattacgtatcgttgcatgccccccttgggtaattttatccagataagccaaattatctttgtttggcccatcagggattggcgttacagtactattcccgcccgtatctggcttaccgtctatattggcctgtagattggtcgctaccggtatgacttagcaaattatccgctatttgatcccccccagtattggaaggacctaacccagctatttgatcaccaccggtaagcgagaagccgaaccgctgcaaccaatatgattcggttgcagcggcagaatttgggaagatttaagacttagagcaaaaaacccagccagttggccgggattcatcatcgaactaaagaactactacttactgatatatatggccttacacgtattacgattttcgtaatgagttcatcggtaataatttcagagtataaatactcacctaaagcatccttctgcaactttatctcaccaacattttcggaaagatacctagatacttctttcccattgaataagatgactatttgcatccagcccgccgtagcacagaatgaaaaaccaatctctaacccattatcatcattggtttgatatgcaaaatgtaaatcagccacttcactagttgccaaaggctctgattcaaaaaagcccaataaatcaatttcatctgggaatgatttaataaacattacttttttccatctttaggaatagttgtgacaaatctacgagaaccatcaggcatgatctcaaaagcagtttctaacttagccgcctttcctgaaggaccgaaaaacaatgactctctcacttcaaagacttgatttcctttagtataagtatctacaacattacccttcgtatttactacctgttttaagtgttcagtaaggatacttgctcctttctcattagtttctaaccccaaacggttcattgtctgagccaattgggtagagcgatcggcgttatgcccactactttttgcattaccaaagagataatcaaacttcttcgaatcaataattgctttagtagcattttcagcgacaactatattacttcccggcaatttcttacccggcaggaaaagacccgccagcattccacctgtggcttccagagcaagctggttaccttgagccgcttctttcacctgtcctgcaaccgctgaccaggtttcactcttcatcagggctttgagcgtatctgccgttgcttgatttttacccgccagatcgtttaatgcctgagtacagtaactgtctaccatggcgcatgaggtgagcgccatcgccgcatcagcgccgtaatccgctccacctaatatcgcatcacctgtgtcagccgtcgcattaattatactgttaacgatagctgagagtgttccttcacccagtttgtctcttacctgatctttcaggttgctcgtaacctgcttaacagactcgcgggcttgatctccactcagagagttattctctaccgcatttttccccgcctgccccccggctagcgcatccgccgtgctgtcacctgtcaaaccaccggccagcccggcggctaatgtactcagtgcgctgacagcctgtttctgaccttcggtgagtgtgttcttgtcccagcccagcgcgctgataatcgtgggggccatcaactccgccgtggccgcgcccgccgcacccgccagcgcatggttgccgctggcataggccgtcaccgcgcccaataccgcgtgtgccattgtgttggccgccggattatcgcccgtactttgcttaatcacccccgccagatacggcgcactggcacccgtcagggccgcacccatattcccgccggccagcccctgcacggcggctgtcgccgcctgcatcccgcgttgcaccgggccgccggtcccaaatcctgacgcgttaaacgcctgattatacgccgtctggtaaatctgctggttgatgtcctctgccgtggccgccttgcccggattggctttctcccactgtttttccgccgcgacgatatcttccggcttcaccgccttcatcttgtcgtttgccgcgtgagtggcaattatcttgccctgcgtggaggcaatatccagcgcctgaccgcctatctcgccaatcagctgcacttctttcagccggttctgctctttctctttatcaaaaatcggcccgatactgccgttggcattcccggtgtcccggctcaggtcatcaacattctgctgttgattctccgtgtcgcgaacggtaatcgtgccctcactcactgccgcctgcgtggtgccttcggcatatccgccattgcccagccccgcgagcaccatgccacccagattactcagcaggtctgaccccaccgggccaccggtgctcaggctgccgccctgatgctccaccgtgaataccgctttatttttgatatcactgaagcccagtgtgccggtatccagcgtgtttttatcggctgccgccgtgctggcaatcaccgcgccatccagttgggtgtgctcccccacccggatatcaacaccgccagagccggcaaaaatacccgtctgcgcctgcaccgaatcatactggctggataacctgtcacggctcatgctcaggttgaccgcggcaccgccccccgccaccggaacactgataccgccgctgacatggctctgcttcgcgtcataaaatatgtaaaagcaaaagccccgaccaactaactaggattttctgtttaacctttacagcgactcaatgccagccgtagtcctgcacctatttcagttggggaactgtctacagagagaataacatcctcaataccatcacctttttctctaccccaaccttccagtttttcatggcgagtcggtgagatcgttataacaccattaaaacaatgaataccgcagtttttcatgtttttaaataaggattttttagttttatagccatatttttccatcaacatggctacccaggcagcgtattcttctttacctttttcaaagtcaaagaatgtttcacattctttgactgtcaatgtacgactatctgacaatgcttgtaagatagtctcaccaatactctgattatctatatctggtggtaataaatgaggtggaaagagattatccgcagcgaccatacccagccctgattgagtttcaataagcaaaaattcattggtgcaatagcagcgagtccaatagtcttgatctttattaaatgtcatcatttcacctgtgtcacagtaaccttaacgccttgccctttcccatactcaatagctcggtttatctctgtccattgagctgaagttgtattggcgggaacagctaatttaatttctcgattggtaatcattgaagagtcgatagtttttcttgaaagagaatattctttaaattttgccacaacatcaacatttccttttatcgagctgtaaacctgattgggattagacaacttcgccatcgtctgagtatccagtgatttagcactcaccgctgttttcgttgatacatcgtaatagtcaaatgtcttgaaattctgcggtaaccgcgcatttgctggcaaggttttcccaacataatcttcccatggcatcccctgcttcatattaccctgcccccatttcatgcccacggctgcggcactgacagtgctggtggctgtattacgccccatataggagagtgctgctttggtcaaatccttccccagcatccccagtgacgcaaccgctacctgattctccggatctgatgcaaaggccgcaaactttgtccaccctgggctattgacatctatcttcgacagatcctgcccattccactgctgaacataggctttggcttcctcgctgctcatcacatcagcaccaaggctactcaaccaacctggacgttcggttatagctatgccaccctgagcaacctccttatcccagacctgagcttccagcggattattcttcagggtttcatccagctttacactttgctcatcgctaactttcttccatttatcaatgacggcctggcagttaccaccagacttacggcagtctgacaattctttatcaaaggtgagtgcctgagtggagtttagataattattctctaccgcatttttccccgcctgccccccggctagcgcatccgccgtgctgtcacctgtcaaaccaccggccagcccggcggctaatgtactcagtgcgctgacagcctgtttctgaccttcggtgagtgtgttcttgtcccagcccagcgcgctgataatcgtgggggccatcaactccgccgtggccgcgcccgccgcacccgccagcgcatggttgccgctggcataggccgtcaccgcgcccaataccgcgtgtgccattgtgttggccgccggattatcgcccgtactttgcttaatcacccccgccagatacggcgcactggcacccgtcagggccgcacccagattcccgccggccagcccctgcacggcggctgtcgccgcctgcatcccgcgttgcaccgggccgccggtcccaaatcctgagtcgttaaatgcctgattatacgccgtctggtaaatctgctggttgatgtcctctgccgtggccgccttgcccggatgggctttctcccactgtttttccgccgcggcgatatcttccggcttcaccgccttcatcttgtcgtttgccgcgtgagtggcaattatcttgccctgcgtggaggcaatatctaacgcctgaccgcctatctcgccaatcagctgcacttctttcagccggttctgctctttctctttatcaaaaatcggcccgatactgccgttggcattcccggtgtcccggctcaggtcatcaacattctgctgttgattctccgtgtcgcgaacggtaatcgtgccctcactcactgccgcctgcgtggtgccttcggcatatccgccattgcccagccccgcgagcaccatgccgcccagattactcagcaggtctgaccccaccgggccaccggtgctcaggctgccgccctgatgctccaccgtgaataccgctttatttttgatatcactgaagcccagtgtgccggtatccagcgtgtttttatcggctgccgccgtgctggcaatcaccgcgccatccagttgggtgtgctcccccacccggatatcaacaccgccagaaccggcaaaaatacccgtctgcgcctgcaccgagtcatactggctggatagcctgtcacggctcatgctcaggttgaccgcggcaccgccccccgctactgggacactgataccgccgctggcacggctctgcttcgcatcataattatcgcggtcctgctggctttgcagagtaagattacgccccacatcggccttgaccgtttcagcgctgacctgcgcgccggtcagtgccgtatcgcggccgctgcgcaacgagaacattccgccactgtcgacggtggtttccgtccagaaagtgccgtcaccgcgctcattgccctgccccttgttggcattggcaaagacgctcagaccgctgccccccacactgacgccaacgctaccgccacggctgctgttactgccgtcggttttttgcctattggccgcgccgagtaaccgcacgtcacgcgccgcatcaagccgggtatcgcccccggctttaagctggctgccagcgatcagaatatcgccgctgtttgccgcattcccgccaccggtggccttgatgctcaggttattacccgccgtcagggccgaaccgctcacctgggtctgttcctgctgttgctgcgaggacgatttttgtgagcctaacgacacactgacgcccaccatctcagcaacaccacctccctgcgcctgcaccagttgcccggcctgcaccgcctgcacccccgacagcgccgctttgaccccttgcaatcccgccagccgcccggtgttttcttcgcgggccgctttggcggtggtgaccgccgtattgacggcactgccgaccggtccggacagcgccaccgtcaggccactttgtttactctcggcagtatactgttgagaacggctattttctgcggcgctgatcgcgacatccgcccctgtcagggcgaggtctttacccgccaccacgtcgctgccgtgaagggctaactgatcgcccgcctcgagacgcacattgcccgtcaggctgcccaccgtgctgccaatatggctcaccgtttgggtctggtcggtggttttctgccgggaagtcccgataaagacaccgataccgccggtgctcatcaggccggattttttctgctcgaatagctgagacccgctctcgctctgctgcgcggtgctcacggtcaggttttcctgcgcacgcaggcgaatatccttatcggccaccacgctgctgcccgcgaccgcgatattttggctactgacatcaatggaacccgccgagagcatcgagcccaccgccagcgtctggctccggccctcctcgctgcgggtggtggtgctggagaccagccctttggcagatcccagtgtagagctgggatctcatttttagattaggtcttcaccattatgtagaacaattacatggtcttcacccaattcatctttgactaacctagctatttcatttgtacatatttcaagcattttattggaaacactaatataaaaataagattcaggatctaaaccaaactcattcgaaatttctttatcaaatggtcctagtgtactagctttatataaaatatagtgttctggaaatatctcaggatatttagccaaaaacacatccaattttttttgtagttcatcgacagataatgtcgtatagcatcttaaatctatggacataattcctcacttcacgcgaattgcattgcctgatttatcaataacaatgactttatctaaccccattattggccattttgtaagttgacgctgtaattcaggagcagagactttagtatcagacatattaatcaccacattattagtctgtcgtttatcaattttcccttttacttcagtccatatatttctaacactactagacttaggtgcataattatcaaaaatttccccattaatcttataatcaggatcttttcttcctgaaacgatagggttttgctctacatggaaccctgatttagccagtatctgcgcactctcattttctctattgagtgagcggatattttcttttgtcatttgaggagttgtttttgtaacatgcccagtcaataaaccgtctgatttggctattgtgttaccaatctttcctgtctgccaaatactactttctggtgaaataattccaccacctggtttatcaacaactttactccctgcgactccaccgaaaacagctaaagatccaagagctatatttttaccaccttcagcatatttcccgtcaataacttgaccaatacccgttcctgtttgataagcaccacctgtcacaaatgtgcctcgaattattgaaccgggtgccccaggtaaggcaattaatgcgtcaacaccaacagcggcttgccctgactgtacgctatacatttttaagtagcttaatgcttcattataagttttggcatccgcggctgaagccacaaacgcaccacctttaactaaattttgaatagcgacagtagcttcttgctctgtaaaaccataaaccgtttgtaattcatatccatattgattgagcacgttagctaaatcttgcttttgactttcattcaattgaccattgcgatattgctcaagtaaaacattgctcgctttatcttcattagtgagatagacgatattttgagatgcttgcagtaggtttttaccttccttttggtcatcaagtgctttcattagcttttcattttttgttgctgataaaaagttattctctaccgcatttttccccgcctgccccccggctagcgcatccgctgtgctgtcacatgtcaggccaccggccagcccggcggctaatgtactcagtgcgctgacagcctgtttctgaccttcagtgagtgtgttcttgtcccagcccagcgcgctgataatcgtgggggccatcaactccgccgtggccgcgccagccgcacccgccagcgcatggttgccacgggcataggcagtcaccgcgcccaataccgcgtgtgccattgtgttggccgccggattatcgcctgtactttgcttaatcacccccgccagatacggcgcactggcacccgtcagggccgcacccatattcccgccggccagcccctgcacggcggctgtcgccgcctgcataccgcgttgcaccgggccgcctgtcccaaatcctgactcgttaaatgcctgattatatgccgtctggtaaatctgctggttgatgtcctctgccgtggccgccttgcccggatgggctttctcccactgtttttccgccgcggcgatatcttccggcttcaccgccttcatcttgtcgtttgccgcgtgagtggcaattatcttgccctgcgtggaggcaatatctaacgcctgaccgcctatctcgccaatcagctgcacttctttcagtcggttctgctctttctctttatcaaaaatcggcccgatactgccgttggcattcccggtgtcccggctcaggtcatcaacattctgctgttgattctccgtgtcgcgaacggtaatcgtgccctcactcactgccgcctgcgtggtgccttcagcatatccgccattgcccagccccgcgagcaccatgccgcccagattactcagcaggtctgaccccaccgggccaccggtgctcaggctgccgccctgatgctctaccgtgaataccgctttatttttgatatcactgaagcccagtgtgccggtatccagcgtgtttttatcggctgccgccgtgctggcaatcaccgcgccatccaactgggtgtgctcacccacccggatatcaacaccgccagagccggcaaaaatacccgtctgcgcctgcaccgaatcatactggctggataacctgtcacggctcatgctcaggttgaccgcggcaccgccccccgccaccgggacactgataccgccgctgacatggctctgcttcgcatcataattatcgcggtcctgctggctttgcagagtaagattacgccccacatcggccttgaccgtttcagcgctgacctgcgcgccggtcagtgccgtatcgcgaccgctgcgcaacgagaacattccgccactgtcgacggtggtttccgtccagaaagtgccgtcaccgcgctcattgccctgccccttgttggcattggcaaagacgctcagaccgctgccccccacactgacgccaacgctaccgccacggctgctgttactgccgtcggttttttgcctattggccgcgccgagtaactgcacgtcacgcgccgcatcaagccgggtatcgcccccggccttaagctggctgccggcgatcagaatatcgctaccggtgatcccagagtgaagctgggatcttaatactagtttttaagtgtaaaaaatttacccaaaacagattgtaaatctccggctataaccatttttccaatacatcttttaactctaactattgtttatattaaaatatttcatcaaacgccctacatcaaatattttggggtgtagttcactacctatgggatttttcttgttatttttagacatgttctttcttagaatttatgcctaagcggaacatttcagttggaaacaaaggctgtaatattacatcattgttaaaaataaataattttggggacagcgcagtaacatcgtggatattttcagaaagcaagtttaaatttgatctaaaaataggaatactaacatcatctacaaaaacgaatacattatcgttttctatagagtttgcattcaacagatgattaatgtcttcatagtctgaatattcaatctctgaccaagagatattgccatttactaaaggatatttattaaaaatatcaatagcatccttctgaagccgcccttcgactataataaaatcagcactaagtgcttctttacactcttcaaataaagtcattttctctacctgtttaactgtctcaatatcgtttcaaaagattgttcattaccctcaaatggtacgaccttttttattgccttgcccggtcctttaccttgagaataatcccatacattaatatgagtacctttttcaggatcataatcaactcgccagcctactttcccatcgttggattgacgcccaataacttttccactcccagcacttatctctagccgtccaataacaggtttagagtctgctcctaaatcaccaacaatatctaatgctttatttcgagcactttcccaattcttttcaggtttaagtgttgtttcaattttatttcctgattgcagataggccaaatcatctttattcggcccatcagggattggcgttacagtactattcccgccagtatctggcttaccgtctatattaccggtattagtagcaccctgacctgtagattgatcattacctgtatgatctggcgaattatccgctatttgatcccccccagtattggaaggacctaacccagctatttgatcaccaccggtatgagcaggaacatatttatcctgaagtgaattcagatatttttcggtaacttcatcattgcccatcatcttcagcgtaacaagatgatccagatcgtcttccgatatcttgtctgcgatctctttggccacaacacctgtaatacccgctttaacgccgatttccagaacttgcttcgctatcaggcttcgacacggtgcagcaatgccacaccctttgagaaccaggctcagcgcattattctctacaacaacttcatccgacatgaagttagccagtgaacatcattttcccctgtgcacttccataccacagagcagggacggttggtgattgagactgagattaagttctgacagttaaaaagcaaaatcccggctcagtggccgggattttgataaaaatttaaggtacagatattaattgttcaggtaataacgcaagttgcgctatcgttcgtccttcatcatcacagaactcaacctcataagctgtcacaggtttagaataaacatcaacaacagcgccttgcatacccgcacataatccttcatcaggaatatcatgtgctaaggtaactatatcaaaaagtgaataagccatactttatcctttacttcacataaattgtagtcatacgaggagttgaggatcctggatcatatatccatcctgtacggacggttactgtattaccgttaggtcctgtaattggcatatctatggttacacgctgaccaaacttatctgcagtacctaatttagccggactcgatttcgctccttcttgtacttttgctattaaatcccccgcatttgactggttgtagcctaacgctgattcaaacactttggccttattaccacccacagggtgttcagtatttaatgcgtatgacgtgagtttattgggatcaataattgctttatcggcatttattaattgacctgaactagaagtctgagctactgcttctgaatgagtataatttttccaattttcagtagggccagaaagtttttcacgtgacggtatatttgctgtggcttctgttgtagttcctttcccaccaatcggcagagccttcgccggtaccactattcccgttagtatccccgctaaattctcaagggctcgttgatcaccctgtgaggcttttacgacggtattcttaatcgcttccccagcctgaccattaaacaatgattccagcacttttccgacagcctgatctttcttgctcagatcatttttcgccgtagcacagtaactatcacctgtggcacaactgaccagcgccattgccgcgtcaaggaccagatcaccaccggccatacccagatcgccggtatcgccaacgaagttcaccaggccattagcaagctgagacccaaggttttcacccatagcctcacgtatgagtgctttggtggcttctttactttcctgaaccgctgcccgcgccttgtctccgctcagcgagttattctctaccgcatttttccccgcctgccccccggctatcgcatccgctgtgctgtcacctgtcaaaccaccggccagcccggcggctaatgtactcagtgcgctgacagcctgtttctgaccttcggtgagtgtgttcttgtcccagcccagcgcgctgataatcgtgggggccatcaactccgccgtggccgcgcccgccgcacccgccagcgcattgttgccacgggcataggccgtcaccgcgcccaataccgcgtgtgccattgtgttagccgccggattatcgcctgtactttgcttaatcacccccgctagatacggcgcactggcacccgtcagggccgcacccagattcccgccagccagcccctgcacggcggctgtcgccgcctgcatcccgcgttgcaccgggccgccggtcccaaatcctgagtcgttaaatgcctgattatatgccgtctggtaaatctgctggttgatgtcctctgccgtggccgccttgcccggatgggctttctcccactgtttttccgccgtggcgatatcttccggcttcaccgccttcatcttgtcgtttgccgcgtgagtggcaattatcttgccctgcgtggaggcaatatctaacgcctgaccgcctatctcgccaatcagctgcacttctttcagccggttctgctctttctctttatcaaaaatcggcccgatactgccgttggcattcccggtgtcccggctcaggtcatcaacattctgctgttgattctccgtgtcgcgaacggtaatcgtgccctcactcactgccgcctgcgtggtgccttcggcatatccgccattgcccagccccgcgagcaccataccgcccagattactcagcaggtctgaccccaccgggccaccggtgctcaggctgccgccctgatgctctaccgtgaataccgctttatttttgatatcactgaagcccagtgtgccggtatccagcgtgtttttatcggctgccgccgtgctggcaatcaccgcgccatccagttgggtgtgctcccccacccggatatcaacaccgccagagccggcaaaaatacccgtctgcgcctgcaccgaatcatactggctggataacctgtcacggctcatgctcaggttgaccgcggcaccgccccccgccaccgggacactgataccgccgctgacacggctctgcttcgcatcataattatcgcggtcctgctggctttgcagagtaagattacgccccacatcggccttgaccgtttcagcgctgacctgcgcgccggtcagtgccgtatcgcggccactgcgcaacgagaacattccgccactgtcgacggtggtttccgtccagaaagtgccgtcaccgcgctcattgccctgccccttgttggcattggcaaagacgctcagaccgctgccccccacactgacgccaacgctaccgccacggctgctgttactgccgtcggttttttgcctattggccgcgccgagtaaccgcacgtcacgcgccgcatcaagccgggtatcgcccccggctttaagctggctgccagcgatcagaatatcgccgctgtttgccgcattcccgccaccggtggccttgatgctcaggttattacccgccgtcagggccgaaccgctcacctgggtctgttcctgctgttgctgcgaggacgatttctgtgagcctaacgacacactgacgcccaccatctcagtgactccgcctccctgggcctgcaccagttgcccggcctgcaccgcttgcacccccgacagcgccgctttgaccccttgcaatcccgccagccggccggtgttttcttcgcgggccgctttggcggtggtgaccgccgtattgacggcactgccgaccggtccggacagcgccaccgtcaggccactttgtttactctcggcagtatactgttgagaacggctattttctgcggcgctgatcgcgacatccgcccctgtcagggcgaggtctttacccgccaccacgtcgctgccgtgaagggctaactgattgcccgcctcgagacgcacattgcccgtcaggctgcccaccgtgctgccaatatggctcaccgtttgggtctggtcggtggttttctgccgggaagtcccgataaagacaccgataccgccggtgctcatcaggccggattttttctgctcgaatagctgagacccgctctcgctctgctgcgcggtgctcacggtcaggttttcctgcgcacgcaggcgaatatccttatcggccaccacgctgctgccggcgaccgcgatattttggctactgacatcaatggaacccgccgagagcatcgagcccaccgccagcgtctggctccggccctcttcgctgcgggcggtggtgctggagaccagcccttttttagtcccggtatgattgcgctgctcgtcatgctgttcggtctgggaggtgagagtgacatcgccacccgccgccagtttcaacgcgccatccgtttgcaccgcgctggcactgagggtgatatcgtttgctgtctgcaaattgatatcgtccgtggcgttcaactggctgccgaggagcgtttcatcatagagattgaccgagctggtatggcgcttgctcgaggacacaccggtaacagacaggctgtcggtggccgcgctgagagtaatattctgcgcccgcacatcgatggtaccggcattcactcgcgcgcccacggcggtcaaattgtctacgttggcgcttagcgcaccaccgaccttcacctcgctgcccagatggcggagagagccactggtcgcactgccgccgccatactgcgcactgatctggtcgctacgttgcaccgtactgagaagccagtcgccaccggtgttcacctggagatccttgccaatattgatgcccgcgccctgctggataaaatcgcgttgggctgtgatcaccgcgttattactgatattgaggctcgccagcggcccgaggatcgtttgtgtccgctgcactgcgccgttaccgctgctgtactgatcactggcggtacgcaggatcacatcgcgcccgctgtccagttgcaggttagtggcattgagtcgcgcgccggtcaggtcaatatcgctgttcagcgtgctgagttgcaggtgattacccgcctgaagcaagccgccacggttgttcagggtgatgtctttcgccatgctgatttgcaggttattggtggcgctgatcgcccccgcattggcgaacccctgtacctcggtcaggctgatattctccgccgcaatcaatgccccgttagcacgtagatcgcccggtttaacccccgccagatagaccacggggactaatacggtttgcccggcgacgtcacggttctccatcagcacgatattgccggttaaggttgccatctgctccgcactgaggcgcgtacccggtgccaaattgaacgctttgctgtactggaccccggcggcaaagagctgctcgaactgcgcctgttcgctacggtaatcactggccaccgttctccccgtcaacgccagcacctgatcccgtaacagccgctgttcataggcgttatcccccagccgtttgtgtatcaccgaaggatcgctgctcagttgctgcaaatagaggtccgaccctttccagttattcaggctggcaaacgccggatgggtctccaccagatagccgccgctgaccgcccgatctggggtaacaaggccggttcggttgagatcgtcagacgggggaggaaccccacgctggcccgtggcatcgagagaggaaggggggctgatattcgcgagagataacgccgcttccgggccgggggcatagtcacctttatcggtcttgagctgatacagcccgctgcgcgggagcgtcagggagatcccgttgaactcgacagcgatattcttgcccgtgctgtcgcgatcacgtggggcgacaatcgcaccgggtgctgccccattgtttatcaccgtattgttaatcaccgtgccgctgccagtcagggttttggccgtgatgctcgaggcatattggttgttcgggcgcagcttcatttccggcccccaggcgatgccccacaacttacctttataggtccggtagcgatactcaccgctggaggtggtctgctcaaccagacgttgttggctcccccagtcatcttgttgcagcgtgacccccgtaagatcgatcacgccttgcgcactcactttactccagttgttttccagcgtgcccacctgaagcgtcaaattgccacccgcgagcaattgcgcttccgagctgatttgatcgatgcggttataggcaacagtcgaggtgtagttcgtgccgatataatcactgttcattggaccaccggcagggggttgagtataacgcccccccggaatatcggggttttctgccgtccagtaagccgcccccgtcacggtgtcacccacgataaagtctgtcgtggccgttaaaatctgacggcgattggtcagcgttttggcgtaaaccagcagatcgtttccggattcaatcaggccggaaaggttgagcacctgggccgcagacgagtaattgccactattatcttgcccaccagccagaataaccttgcccatgcctaacagggtggtggtcggtgcggtatcggtgcgcgtgacggtatcactgttttcaattaccggtgccaacagcgctagtgtgccgtttttatccgttgcaccgatcagggcgttaggacccgagttagtgatgcgttcccgcgcgttaagcgtggcggtggcaccgatgagggtgccgctattaaacaaggtgttggcatcagtactgagcccaccacgggttaatatttccccgcgattagtcagtgcgccagatgcacggagatcggcttgcaccgcacggatattgccgttattcagtaaactgttcgaacgggtgctcagtttgcgccccgccaacaactgcccgtcattggttaaagcgccgtgggtggtaaaggagaaatcacgcccggcctgaagggtagagtcggccagaatgttgaagtcacgctgtaaacccagagtcagatcctgactggccgctatcttgcctgtgcggttatccagttggccaaggtttaacgcgatgttactcgcctgaagtgcgccgccttggttattgagggtttgccctgcatttgcgcccgcattgatagccagcgagccaagggaaagaatattggcgcgctgggtgctgacatcccccttgttggcagtgatggttatcccgcgggcttgcgtctggctgccggtgagatcaaccctgctgccggttaacgtcatggcaccggcggcaaggctttgcccgtgcgcgattaagtcctgacggaccgtcaccgccagatcaccggcgttcgtcagcttgccatcactttgcacacccgcgcctaacaggctaccgctgtcgctatcaaggccctgcgcctgtatggccacgttgcctttggagaggattgtgccaccacggttatctaaataacccggtagattcaggttgaaatcggtggcccccgtttgcgcgattacaccgccgagattggagagcgcttgcacatcgaacgtgagctgatcggctatcaaactcgccttatcggtacgcagcaaggcgctgggactggccgatgcttgtgttgatgatgatgattgtgttgatgatgatcgtgttgaggatggaggtatagatgatggcggtataaataatgatcgtgtcgcggctagctgggtcactaatagctgagtggcggctttaatcacggcgctcgttaatgtgatatcacccgattttgccgtgaggctgatggcgttggcctgagtctggctgccggtgagatcaatctggctacccgccaacgccagcgaccctgcggcaatattttgcccttgcgctatcaaggcttgctctgtgctgaccgccagattaccgctgtcgctccggctaccgtcggccttcaatcccgccgccatcagggattgattgtcgctaagtaagtcgttagcccgcagttggagatccccaagtgcggcgatggaaccgctgttgcgtacactgccctttgtcagccactgtagcgcgccctgggtataaaccgagccagtgttaacggcattcccctgcgtggtgatgtcgctgttccctgcgccataaaggctaccgcggttatccagattaccctcggtcaataggcgcatttccccgttggcgacgtgcagcttgccttcgttggtcaggttaccggcgatggacaaccgcatctggtcacctgcgctgtacagcatgccgctgttattaagctcaccctgagacgatagctgcatctctccgcgagtttgcatcacgccgcggttagccagattgccggtggcggtgaaggtcagttgctgttcagtgtaaatttcaccgatgttctcagtattgccgttgacggtaaattgcccgacaccggtggtatagatagccccgcggttaaacaggctatcggtgctcagtgacaagcctcgcccggccagcaggctgctattatcagcattagtattacgatcagcactggtattgcggatactgagcgcggtgagctgcatattccgcccggcttccagtttatattggttaatcaatgcgccacggctgttaaagagcagatcacgccctgccgttaaacgcgcgcctgcctgatgaatgaaatcgctttgtagacgtagccacaggtcggtcgctgccgcaatttccccgttgctgttctccagtttggccagattgagttggatattatcggcatgtaatttcccgccgcggttattcagggtttgttcagggttggctaccgcagtcatcgagagagtgccgggggtgatcaaggtcgcctcgcgggtcgtaacatcaccgtcacgggcggtgatcgtgatattgctggcgtgagtctggctgccagtgagatcgatgcggctaccggataatgtcatggcacccgcagcaacattctgcccctgagcaatcaatgcttgcgtggtattgacctgtaaatcccctttgctggccttactgccatcggcttgtatgcctgcgccaagcaaactctggctattgctggtcaggcgttcggcttgcagtgccagattgcctttggtgagcagcacaccgccccgattgtccagatagccggggagatccagcctaaaatcaccgctgcctttttggacgacccgcccctcaacgttagagagggaatcggcggtgagattgatttgatcagcggtgaggtaagccttatcactgcgcaggatctggcgggtatccgcaaacaacgtgttagccgccatcaccgtggcaccggttaacgcaatatcgccttccgtggctgtcagccgcatatccttggcttgggtcaggctatcagtaagatcaagccggctgccggagagtgccagagtgcctgcggctagcgttttcccttgagcaatcaaggcgtgccgcgtagtgacattgagatcaccacgcggagccagtttgccatcactctgtatgccagcacccagtaaactctggctattactggtcaagcgttcagcttgcagcaaaaagttgccgcgggtgaggagagagccaccacggttatcaatataacccggtagattcagattgaagtcagtcagcccagtttgcgttatcacgccacccacattggcgagcgcttgtgcgtcgagcgcgatttgctccgcgaacaagttagctttatcagtgcgtagcaaagaaggggtcgaaacagacagacgacgattggcgaacaggttagcccctgtcaaatcgatgtcgccaccttcggtggtgaacgtcagatcaccgctctgagtttggctaccgctgagatcaatacggttcgcattaaatgtctgcgccgtgccgctaatatttttcccttgggcggttagctgcccacgggctttaatatcaagggtgccacgggtaatgacactgttatcagatttaatgccagcacccaaaacagaattacggctgctgttaacctctgccgcgcggatcaaggtgtcacccgccgccgcgaccgtgccactgttgctcagtttacccgctgtggtcagttgggtattgcccttcccatagagcacaccgctattctctatgcctgagggggtattcaccgccagttgttgagcactgctgatctggccgcggttcaccagcataccgtcggccgtaatcacgatatcacctgcagaagcccctatctcgcccgcattgtgcacgccaacaccggtttcagtaccgattaggcggattttaccggcgtacatcccccccaaattagccacatcgaccgccacggcaggacgatggcggccatcggcggcgttggtattgatattctggtgtgcggcatcaacctgattgcgcccggtagtgatattcagttcattggcccagatgcccgcatttactttaacggaacgggcgatcagatcggtatgatcctgaccacggctgtccaggccctttccctgaataacaatttcaccccgttcaacatcgtagccagtgagttggccgttattgagctgcgcctgaccggtggtgagggttgcgcggttggcgttgataaaaccacagccctcgcaggtaatgcctgcggggttagcgatcaccacctgcgctttacgtccggccacttcgatatagccgttgagctgactcgggtcgcgactgttgacttcgttgaggatcacgctggcttcgccccgcgccagccacggattaccatcaaccaatccggcaatctgggtctggttgacaccgcggccgttattgaggatcaccccgcgattatcgacatcaaactggcggtaagcgttgcgcgagacaccgccgctactgggggtttggatattgacctgaggcgtgccgttggcgctgctgataatggtcggctgctggttacccggcgcactgccatccgccacaattgcggcctgaacggataacgagatgcaacccaaggcgattaacagacgaaaactcaatggtgataaggcactgacccggcggcgctgagtatgcccaacacctgacgatggcgacgatgcagcccggccggaggccgcaatatcggcgaccaccatcaacatgccgcgcgcttgattaaaaacaatacggtacaggtttttattcatggctcatcccagagagttaagttaattaacgttaatcggacacatcagtacagccaattcaggttaaaacccaccgccagcgaatcggttttgaaaccattaggtttagagagcggtttccccgcaaacaggtcatagcgggtattcagtacgttgccacgtaccccgaccgcactgcccgccaaatggcggcccaacagataagcgccactacgaccaccgacttcgccgtaatccacaccgacatacagctcatgccccggtagcggcagataccagccgatatcattgcgcacccaccagccgcgatcggcaatcagcgtgcgctcaccattaaaaccacgcaccgaccagcggccaccaatggagaactgatcctgcggcgtcagtggcgtgttggtactttggcgctgatattgcaggttgtaatggaggttttgcgccataaccacaaaaggaatatccagttgcgcattcaatcgcagaattttgctcagggcggtggcttcgccgaaatactcttcctgcgcgggtatggcaccaaaccagcgggtgccacgctgatagctgataccggcatccaaaatcgcctgcgagataaagtggcggtgttgtagcccgatccgccaggccgaggtgcggcggcgctgtacttccacttcggtatcgttgatatagtttttcgacgagcgggttagcacatcgtaggtaaaggtggttttctggctggcattacggtgcaacaaccggctgagttggagcgccacgttctcactttcacctcggtagttgatatcgccattcaggcccgcgacggcctggtaatagtcataacggctggcggtcatgcctgcggtccagtaaccgaatggcaatgagtaatggccggtcagattattcgtgcctttatcgccacggctttgcagtgagccaccagctgagacataaaacagatcgctcagagaaagcgggttatccagaaacaacgtcgcccccccttgatagcggccagtgctgcgggtacccgaatcatccagtgaggcggccagccgccacatttttcgctgttgccagttcagaataatatccgtctcaccgggggcagagcctgggatcaacaccatattggcttgcaccgtgggaacacgctgtagattttccaagccttgttcgatatcgcgtaaatccaacagcgtcccggcacgggcaggaaaagcgctgaataacgtgacatacctattactgtctggcgtcagttccacaccgcgtattttgccgggcacgacgtttagcgccagcgtgccgctgtttaaatcctgctgcggggccagcacacgggtagtcacatagccgtgatcgaccaaacggttttgcatctggctcattagcaggttaatgcccttggcccccagacactggccttgcgcttgatcggcaatgcgttgcaacggcaaccaacggagtaatggctcggccccactgatttttatccgattaataacaaagcagggtgtctccagcggaaaaataatacggctaaaaaaggccgagggcgcagataagcgcacatccggcgtcggcggagccaggcgctcttcaagtgcccgttgccgctcctgttggtgaatactttgttgaacgggcgctaattccgcgccataactggcatctggaatagccactattttcaataatacgccagctactaatatagaataataaaaacgcgacatgaggagttcccttccccaagagcttggggtacataaacataatcattacgttacgccacgataatcataatgacgtgattcctaataattttatagttaataaaaataatcatatgatgggaaaaatcactacagacagacgtgaataaaacataaaaatgaaactattacataagtaactttagctaaattcaatttttaaaaacaaataaagatatagaaatttacactagaataataataaaattcaattattacagtaagttgattttaatcagagtttaagttacgcccccaagtaaagcgttcattccacgtcttagatataagatatattattgaaaaaaattaaattagacaataagtcttgagataaaacattatatttacgataaaatagcctcagtattaaagaggctattgataagagcagttcattcccgcgtatactttaaatagtatcctaagtgaaaataaaattagccttcgtttactcttcgtggtgattaaaataccaatagtatgaattggtttaattaggctacttaaagtctcaacttgtttttgagagggatctgttgagagtagaaccgtcattcaaatacctaacccactcccccttctgttgagataacaaccagatcaactatgctgtaaaaactttatcgcttatgatgtaaaaaattttaccattacatatagtaggggaattagatgagaagactaccggtttacctgttgcttgatacctcgggatccatgacaggcgagcctattgaggcggtcaagaatggggttcaaatgctgttgtccacgctaagacaagatccttatgcccttgaaaccgcctatgtgtccgttattacctttgattcctctgcccgtcaggctgttccactgactgaccttttgaatttcaaattgcctgagttggtggcaaatggcaccaccgcactgggtgacgcactgtcgctcaccgcaaaatgtattggcaatgaagttcaaaaaacgaccgcggataccaaaggtgactggcggccactggtctttatcatgacggatggctcgccgacagatgattggcgtaaaggcctcagcgattttaaagccgcaagaacgggcgttgtagttgcctgtgcggcaggacatgcggtggaaaccaaggtcttacaggaaatcactgaaattgttcttcagttagataccgcagactccagttcaattaaagccttctttaaatgggtatcggccagtatctccgtgggaagccagaaagttgagtcaggtaaaaaagaggttattggccttgatgatttaccaccaccaccaccggaagtgaatgttgtcttataacgttgctctataaaaataaataaggaaattctatgtcagtcagtttgcataaaggacaaggcgttagtttacgtaaaaatgaatatgatctctcctcagtcaccatcggtcttggctgggatatcaacgaagagaaaaaaggtattctgggcagcctgtttggcaagaaagaggaagagtatgaccttgatgtcatcgcattcttgtgtaacgcccaagggaaagtgactgacttaggtaatgtagaaaatggcaaacccagtctggttaatggcgatattatcttcttcaatagccttcgccataagtctgggcaaatctggctgaccggcgataacagaacgggcgctggggatggcgatgatgagcaaattatcgttaagctgaatactcttgatcctaaatacgaaaaaattgtattcatcgtacagatttataatggcagcaagctgcaacagcattttggcaaggtacagaatgccttcatcagagccgtagacgccaaaaatattgaaatggctcgcttcaacctctccggtggccccgcctttaatcaacagtgttcaatgctatttgctgaactggtccgtgaaagtacaggctggaaactgaatgccattggtgagccttctgattctgacacctttgtcactcatcttaagaactacctctgatatgagaaggctacccgtttatttgctgattgacacctctgggtcaatgcgcggtgaatccatccatgccgtcaatgttggcattcaggcgatgatgagcgcactgcgtcaagacccttacgcacttgaaagcgttcatctctctatcattacttacgataaccaagctcgggagtatatccccttgacggcactggagaatttccagttcaccgatattactgtccccagcgcgggaggcacattcaccggtgcagcacttgaatgcctgatccattgtgttgatcgcgatatccaacgatctgatggcgatcagaaaggcgactggcgtcctctggtgtttctcatgactgacggcaccccttcagatgtctacgcttacggcgaggcaatcaaagaggttaaaaagcgggcgttcggctccattatcgcctgtgctgtcggcgcgaaggctaaacatgaacacctcaagcaactgacctctcaggtcgtggcgcttgaaacgctggattcaaccgcattttcaggtttcttcaagtgggtttcggcaagcgtcgccgcaggaagctcaagtgcgggtatcaacaccgggcaggataacctaccgccaccgcccccagaaattcagttggtactgtaatttaaaggcaaagcccccattcacggcgctttgccttatttttttgtcgcatcggtagccaactggcacacattgaaaaaacctaagcctgacgaggtaccatgagaagactgcctattttctttgttctggactgctcagaatcgatgatcggggaaaatctgaagaaaatgaacgatggtctgcaaatgatcatcaatgaccttaaaaaggatcctcacgcgcttgagaccgcctggatttccgtcattgcctttgccggtgtcgctaaaacgattgttcctctggtagaggttgtctcattttatccacctcgactacccattgggggaggaaccagcctgggggcggctctgcaggagttaacccgccagattgatactcaggtcagaaaaaccacggaagagcgcaaaggcgactggaaacccgtggtctatttgttgaccgatgggcgtccaacggatgataccaccgccgagataacgcgctggaaaacgcattacgcccgtaaagtgaacctaatcgccattgggcttggcccttctgcggatctgaacattctccggcaactgacagagaacgtgttgctgttcaatgatacccaagagggcgatttcactcagtttattaagtggatcaccgcgtcggtctcggcacacagccgcagcgtgggcgaggaatcccctccactgttgaatcaaaccgactacatcgtcaaactagcaaaagatgatgtcgccagagcctatgatgaaaactgcgtcacactgattggccgctgtagcaaatcccgtcggccctatatcattaaatatgaacgcccagcggttaacctttcctcactcaatttcaaactcaacattaacggatttaaccttgcggggtgcctgccgattgatgaggattattttgcctggagtgatgagtctgtgtcatcgcagcaggtgaataccagcgaactgcatggcacacctggttgcccacattgcggcaacggcagtgcatttgccatgtgtaactgcggtaaattgctctgtatcaatggcgcggatgatgttatctgcccgtggtgtgatagagggctgacctttaatgtggatgggggcggatctgacttcgatgttatccgggggagaggctaatggatattaacgataatctgcatcaagacgatttacgccaagacgatgtgtaccaaaaggtgttgcgtttactactggacgaggccggaattgttctcccagagactgagttagcggcactcaagcaagataccgcgatccgctccctgctcaatgatcttctcgccagcgtcagcgacaaggctaaacatctcgctctggctaacaatgaaacggtaaccgatgatcgtcagcagttagcctccttgacggaagagaacagtcatgaagtgattaggggcgaggaaaatatcgtaaaagagcctgaccagcagaacgaaaggcttctgttagccgaaacgttatccgctgaaatattatccgctaaaacactggaaccgaatcctcccgctgacgtattacctcccattgaaatacaccataaggtgccggtcgaagaagaatcatggcaagcgatgctgttttccccgattgagcagcacgccaatacagcctcatcggctgcgggcaccaaaccgctcagaccgggtcagattcccgtgggtatgcccaatccagccaactgcccccctcaatacactcagccgaaggcaaaaattaatatcgccaacgcccgtgtcggcaccccttttcactctgacgtcgatatctcactcgataacggggccaaagctgaaattctggacgtgtcttttgcaaaggacattggtcttatcttcgatcaagcgacctcttcgctttcaggcaccccaacggaaagtggcgatattgaggcaacggtgacgtggtcctgccattcagccccctacttttcaaccaaggtgctttttatcgtgaacccggacccgcgcagtttatggaaaatccttgagccgcccgctgatgatcgctatttcaaagagaatgtggatcataagctgatcagcgcgccaggtgtcaatattgcggcggctagccgcagagggcgctcacatgaacatgtgggatcattccgggatgatgatttctttatctccagtaatcacgataccggctggaacatcatgctcgtggcagacggtgccggaagtgccaaaaattcccgcaaaggctcgcaaattgtcacggagacggtgggtcactatctgtctgcccaactgagcggcgataaggggcgcgaattaaaagagcggattataaactggacccccgaggaccagcgggttgtcggagagacctttattcggcagtttcaccacgcctcggtcattgcgatcaacaatattaaaaatgaatcgttgatcgcagaagagaccgtaaagtcatactcaaccacgctgttggcaacggtctcgtttcgtaccggtactgagcttttcgccgccgccttctggatgggcgacggggctattgcggcctacggcccggttggaagagtacgcattctgggcacgccagacagtggcgaatatgcaggtcaaacacgttttcttgatgtcgatgccgttggtgatccggaattcagtaaaagggtcagtatcggaaaatggacgggtatctctcatttggtcttgatgaccgatggcgtgtcagacccccggtttgaaacggataatggtctgcaaaatccgcaaaaatgggatgcgctgatagcagagatctccccctgtctgaacgataatccgcaagcggctgaacagttggcggaatggctaaactttttctctccaggcaatcatgacgatcggacaatggtcgtttcgtggtgatcggactgaattttattgctggtgagtaattatggcgaatattgttacctgtacgacaaaagatggcgaaaccatccagtacgttgacgagatcatcggctcgggctcaatgaaggatgtgtacttctctcccgataaatcttatgtcgtggccttttataaaaaaccacagaatgatcaggcgaaagagcgcatcgatatgatcaccggtcgctaccggcagaatattttcgagcagtccggtggggagtactggaaagatttattttgctggcccacccatgtcgttgagcataatggaaaaattgggattgtggtgcccacctaccaaaatcattttttctttaagtacggttctaaaaacaatgattttcttggcataaaaggccgagagaaagaaggtaaatggttcgccagcgccaataatcagaataaatttctggatccacgcgagcgcggcaatattctgaactacctcaaggtgtgcctactgctgacgagagccgtcaggcggatgcatgcagcgggtctatgccatagcgatctgagttacaaaaacgttctcatcgatccagagcaggggcatgcctgtatcattgatgttgacgggctggtggtaccgggcaaattccctcctgacgtggtaggaacgcccgattttattgcaccagaggtggtgaaaaccagccatctgctgaaagaagatccccaacggattttaccgaacataacaactgaccgacatgcgctctcggtgcttatctacatgtacctgttttaccgtcacccgcttcggggcggaaaaatacatgacatggatgatgaagtccgtgacgagtcactggctatgggggaaagagcgctttttatcgagcatccaaccgaccgcagtaatgccgttaaactcaatcaagtgaagccgtcctctcttccttgggcggatccgcagaaagtcccctacaccattatgggcccctatctgacacagttgtttgagaaagcattcatcgatggcctgcatgacccatccaaacgcccgactgctgatgaatgggaaaccgccttggttaaaacggttgacctcatccagccgtgtcaaaacaccgcttgtgaacagaagtggtacgtcttctcagggaaaaccaagccggtttgcccgtattgcggaaccgcttttaagggaaaactgcccattctgaatttgtactcatcacgaaaagcaggcagttaccggcccgatgatcatcgcctgatggtctggaatggtcagtcgctttatgcgtggcacgttaaccggctcattgcgccgaacgaacgcacatccgaagcgcaaaaaaaacgggtaggctattttgttttccataacgatcaatggtggctggtcaatgaagggattactgggttgatgtcactacccgataaaaaaaccatcggcattggggagaaattggcgctcactgatggtgcgcagttagtcctctccacagaagagggtgggcggttggtggtggttcagcttgtcgctaattgaccgttcagtctgtttctaattgatcgttcagctcgtttctaatcaaaaactaaatatcggcttattcaatggcctgggtaggcaccaggtcattgaatgacacagcgattaccgtgaagcgaagatctgtgcacattagccctggctcctgtgccattcgagaggaacttgtcacataattttgtgctaaaagccatggtaccccccataagacagaaagtgttctaacaactcgcccctccagtaaggttatttttacatccaacgtaccgtaaatattccactgagtaatcaatcagataatataaatttaatttatatatccagaaatcggattatacttactatagttatcggtaacatagttcagataattcgggagtatcaataatgcttaatatcgatcaaaaatacctaacgaacctcgatgaaagcgcgttaaaaaaacaacggatctttatgcggatcgttgctgttttactgctgcttggcggaattttctgtcttattaacccgttagcttcaggtgcagcgctcagtatggtcattgggattctgctgctactcagtggtattgcgatgatagtcggcatgattgccaaccgctcagataacttttggccaatggtggcgggtattttgctgggcgtggcatatatcgtgatgggttatgtattcattaccaatcctgcgataggcatgatcagtctggccgtggtccttgcggtactctttgcttttggtggggtgctccggttgatcaacggctttaaggatctaaaaagaccaggagcctggctacaaattttacttggggtgctggatctggtgatcacctatcttttggtcagcgccgggccattgatgtcaatcaccatggttaccacactcgtggggattgaaatgctgttcagttcgttcagttgctttatggttgctagtctatttaaacgcagctaatcactttcccggcggtatcgtactcgcgataccgccacgctcaatcaatgtcatattcatgacggctatcacaatcagcacactgcgatttcccaacgggcacaccaccgtctaaatttgaataaaaaatctcatccgaccacttgctggattcagtaagggcggcggagatataacaataatggttggttgtatgcctgatggagactgcaatgttagcttaccctcacctgttcaccccgcttgatcttggctttaccacactgaaaaatcgtatcttaatgggttctatgcatactgggttggaggagttacccgatggcccgcaacgtctggcggcattttatgccgaacgcgcagcaggcggtgtcggcctgattgtgactggcggtattgcccccaatatgaaaggggtggtgtatcagggcgcatcggtactgaatgacgccgcgcaaatcccccatcaccaggtggtgacagaggcggttcatcaagctggagggaaaatcgcgctacaaattctccatgcggggcgttacagctaccagaaacacccggtagccccttctgcgttacaagcgcctatcaacccttttgtgccacaagcattgagccatgaagagatcctgcaaactattgctgatttcgcccactgtgcgcaattagccaagcaagccggttacgacggtgtcgaaatcatgggttccgaaggttatctgatcaaccagtttctcaccgcccgtactaatcagcgcgatgatgaatggggcggtgattttacgcaccgaatgcgttttgccgtagaaatcgtgcgcgccgtccgtcaggccacgggacacgactttattctaatttaccgtttatccatgcttgatctggtggaggaaggctccaactgggtagaaatcgagcaattggcacaggccgttgaacaagcaggggcaacggtgatcaataccggtatcggctggcatgaagcccgtattcccaccatcgccacaatggtgccacgggccggattcagttgggtgacccgcaagttgatggggaaagtgaatatcccgctgatcaccactaaccgaattaatgaccccgccgtcgcagaacaagtgctggccgatggctgtgcagatatggtgtcaatggctcggccattcctggctgatgccgcttttgtacaaaaagcggtacagggccgggccgatgaaattaacacctgtattggttgtaatcaggcctgcctggaccagatttttgacggcaaactgacctcatgtttggtcaatccccgtgcttgccgcgaaaccgaaatgcccgaattacccacagacgcaccaaaacggttagcggtagtcggtgccgggcctgcggggttggcttttgcggtaaccgccgcccgtcgcggccatcaggtgacattatttgatgctgccgcagagatcggcggccaatttaatattgccaaacagatccccggcaaagaggaattttacgaaaccctgcgctatttccgccgtcaattagtgctgaacggcgtcaccctacaattgaataccctggtgcaggtaaagcagttggctgagtttgatgaagtgatcctcgcctgtggtattcaaccacgcttaccctgtatcaacgggattgatcacccgaaagtacttacctatctggacgtcttacgcgataaaaaaccagtcggccaacgtgtggcgattatcggtgccggtgggattggttttgatactgcggaatatctcagccagtctggtgatagtccccgtttcgatagcacagccttcagtaccgaatggggtattgatcaagatttagctcatcgggggggcctatcacccgcgggggctaaagtccctccatccccacggcagattttcctgttacaacgtaaagccagcaaagtcggtgaagggctgggtaaaaccaccggttggatccaccgcaccagcttggcgatgcgcggcgtcaagatgcttaacagcgtcagctacgaggccattgatgataaagggttacatatcattcgtgcggaacaagcctgttgtttacctgtcgataccattattatttgtgccggacaggagccacgacgggagcttcatcagcccttactggatatgggaaaaacagtctatttgattggtggtgcagataaggctgttgagctggatgcccgccgtgccattgatcagggtacccgcctagcgctagccatttagccaagagaagaatggcgcgaccagcaaggtaaagggccgtaacaaggccgagaatagcaatagaactgagaataatcacagggtgtggcgaaaaccccaccctgtgaaataccgattagaaatcgctatatgacatatcgagactaccggaaccgccgccttctgagcgagaggaggcctgcttaaccgatttcagcaccataaatttctggtttgaatccagtgtttcgcagttgccaaacaaacgcttgagcttatggaagtaatccagatggcggttacccacgatcatcaactcgccacccgctttcagacaacgcttggcatcacagaacatctgccaggcgacatggtcactgaccgcatgttgttggtggaacggtggattacataacaccaattgcaggctttcacgctccacacccgccaaaccatggctcaccataaattcacagcgcgacaagtcttgcgggcggttaaccgtgatgttcaattcactggatgccactgccatataggattcatcaacaaacagcatttcagctagcgggttttgctccagtgcgattaacccgacgacaccattcccacaacctaaatccgcaattttgccggtgacatcataaggcaagatttccataaagaaacgcgcgccaatatccagattattgcgagagaaaacgttcgcgtgattatggataatgtagtccgtgttaggcagcggccaatcgatggtttccggcgcgtcagccaatggaatatcagcaacctcgcagtgaatcagccgcgcttttttccaagccagcgtcgttttggttggccccaggatcttttcaaacagttgcagcgtggagttatgcacatcgcgggattttgcaccggcaatgatcaccgtatctggtgccacaacgcgacgcaaagcacgtaattgatgttcgagtagcgctaaggctttcgggatcttaatgaccaccagcttaggtgcctcgggtaagtcatcgacgctgctcagtaatgtcaccgcagattcatctaaatggtttagacgcaaattatgcgccgtcgccaactgactcatataagagtcactggaactgaacgggcgataagcgtgtaaagcgcaggccagcgtaccaaactgatcgttaaacaccagcaccgggcggccatcaatttggcttaaatcaatgttttgtagcagatattcatctgccgcttcccacgcctgaagggtattggaattttcttgtggaggaaaacgctcaagctcaaggctttgcgttcccagatcgagttggctcatcaccgctcctgaataataaatttgggctgtttatcccctaaaacgggcgatcagtaaaatgtttttttgctttaatgcgttttaaacgcgcttgtgccaagcgcgaacccacaccgcaagtgctgattttactcttttagtctcagaatatcctactatacccgccatactgtaaacagcatgtgcgttggatcccctcctgtaatgcgcattatttggggtgaaatccccataataaaatataaataacaaatagaataaaaacaaacatacttattatttatattaaaaaagagttcacatcaataaaaataaaaaactacaagatttaatgagacttataatacaatcgccctcggtaaaaaataccacattcaaatatcacaaccctaaattaataaacccaaatataacaattatagtaataaattattcgttaatttggaacacacacggattggtaaactctaaatcatgaagaattcaaatagatcaccaaaaaacatatcaagaaattttaaacatcataaagaaacctctctttcaagtaaaaataaaagtcctatcgcaacatgtgtcgcggcggctctctttatatttggcagttcatcagttatcgcgaacccggaccatgaaggtatcgttgtggggaaatcaatcctcaataaaaagcagagtgcggtaaatgccataataaatgagggtaacagtttagtactcactgacagtgccagcgcagagcatacggccgttaatactggcagtatttttacgttaaaagaggatagtacagccgatataacctcggtgacggggggcttttttagtttatctggtagcagtaaagccaatataaatacggttctttctggagggtggctagaggtcaatgacgatgcaagcatcaccgagacaacgatcagctcagatatcgaaaaaaaaagtactgtgcgcttataccaagatggaagtgccacaaaaaccactgtcggtgataatggtattctctatgtttcaggtgatagccgtgcagaagagactcatgtaaccaaaggaggaaaattgattgtttacagtgagtctcagggcccgacactgaaaaacactcaaatcgcgggaacattaaccttaaaaagtgatgtcacactggaaggtaaaaccgagtttgtctctagcgcaaccataaaaacaaccggtcatttaattgataaccagggtcaacttattttcaatagtgataaagatatcgttattgaagccatgatcgatggccaaggttcattaaccaaagaaaatccattaaccacattaacgctatctagcgcgggtgacgcgtgggttgccagttatgtctattccggtgaaacacatatcaatgcaggcaatctaaaactcgccaacacccatttttttggtagcccgattagtggcaatccaaatacacgccttattttagaaaaaagcacactcgacaccaccgtacagggcagtagtgtatttatcgataaacatagcatatggaatatgcagggtgattctaacatccatcatttagatatattggattcagggagacatgatttaaataaccctggaaaaacgggcaatcaattaatcattaatggcgattacttcagtgataacggcacgttgatttttcatagtcagttagcgggagatgactccgtcactgaccacatactgattaaaggcaattcggggggccataccaacgtccgagtcattaatgtgaacggtgaagggaataaaacagattcaggtatccaattgatcgaggtgagagggatatcggatggggagtttagccaggttggccgtattaccgcaggggcttatgaataccgtttaggccgtggtaaggacgaactcagcaaaaactggtatttgagcagtgatattacggattactcttcagacggtgttcccgaagcagaacttccagggattttggttctaaaatcagataatgccgcagtcttttcagctaaattagctgattacgcgttgcaagccgttggcggcgtggtcgattccttcacccaacccgagactaacaccccaagtaacacacccgaattacccgctccagacccaaagcgcgccaatgccgcagtcttttcagccaaattagctgattacgcgttgcaaaccgttggcggcgtggtcgattccttcactcaacctgagacttcccccccaagtaacacccccgaattaaccgttccagacccaaagcgcgccaatgccgaagccttttcagccaaattagctgattacgcgttgcaagctgttggcggcgtggtcgacactttcacctcacctgagcaaactgagcaaactgagcaaactactgcaaccccagacagcacaccgaaatcaaccgattcagcggtgaaaccagcaagcacacctaaaccaaccgatttagcagtgaaacccgcaaacaccgtgatcagcaatgccaaaacagccgcacccaaacgccagactttagttcatacccccgaaaacgggagctacattgccaatattgcaatggcaagaaacctgtttaccactcgtttagaagatcgcaccagccattatctctataaagatatcgttactgggcaatggcagcctaccagcatgtggatgcatacccaaggcggcagaagccagtttggtcatactgttgagcaattgaatatcaaagggaactactactctgttcaacttggtggggatattgctcaatgggcaaccaatgagcaaggcagtgggcgaattggcatgctggcagggttaggcaaagccactaaccacagccactctaaggtgacgagctaccattcacgcggttccgttgatggttacaaccttggcatatacgcaacttggttcgccgatcagcaacataataccggcgtctatattgatactctggcgcagtatagctggtttaataacgccgttaatgggcaagataaagcagaagaaaagtataaatcatcaggtttcactacctctatcgagagcggctatacctttaatttagcgaatagcgatcaactgagctatttcatccaacccaacgcacaaattacttgggcaggcatcaacgcacaaacacataaaacagccgacggagcggtggtcagttaccgcaataacgggcatttcatcactcgtatcggggctaaagcgtatctgcaaacgcatgataccctgaatacaaaattcaccccttttgttgccgtaaactggattcaccaaaatcaaaacaccggcaccacaatttcaggccaagggattgataataagatccaaaacagcactgaattcaacgtcggcgttgaaagccaaattgaccaacaactgcatatttgggcgaatataaatcatcaaatagggcgttataattataccgataccaacgcactggttggcgtgaaatatcacttctaatatccattgataaaacgatacctgtgcctatggtgcaggtattgacagaccgctaatcccgataacatgatcttaaacagtgaagatagccagagaagtaaggcgtccacactgaggaaagttcggtaccccgttttgtttaatcccctattcaggctattatcgttagatgattgatttctctcactgttgctcttaacttaatcagcgtattaatttaaccagagtattaatttaaccagagtagccccctttatgtcggtattgacctatctacaaggttatccagaacacttacaaactcaagtccgccagttgatcactgaacaacggttggggaatgtcttacgccaacgctatccacaacctcatgattacaatacggataaaacgctgtatcactacacgattgaattgaagaaccagtatctgcgcaatgcacagccgttgagcaaagtcgcctatgacaacaaaattcaagtgatgaagcatgcgctaggtctgcacacggccatctctcgggtacaaggggggaaattaaaatccaaggcggaaattcgggtggctacagtgtttaaaaatgccccggaggccttcctgaaaatgattgtggtccacgaattggcacacctgaaagaaaaagatcacaacaaagcattctataatctgtgttgccatatggagccgcaatatcatcagctagagtttgatacccgcctctatctgactcacttagatttgtttggctcgatttatgcgtattagattgatcaaaatatcgctaaagtcattgggcttgcagttaatctgctgcgccatcaaatacgaaggggtaactcaaaataaccaaactgtagctctgcgggccgtaataatctgacggctcaacctgtttttcttctacctgtttttcttctacccgtttttcttttactggtttttcttctacgtgcttttattttataggaatggagttaacgatatgattcgcttcgctgttattggcaccaattggatcaccgcacgctttgtcgatgctgcccacgaaagtggcaaaatgaaactggtagccgtttactcccgcaagctggaccaggctcagacttttggcgatgattatcacgtcactgactgttttgataatttggaagccttagccgcaagtgatttgattgatgcggtgtatatcgccagcccgaatgccttgcattattctcaagccaaactcttccttagccataaaaagcacgttatttgcgaaaagtcgctagcatcgaatctggcagaggtagagtctctgatcgcttgcgcccaccagcatcaggtggtgctctttgaggcctttaaaacggcttatctccccaactttatacaactacagcaagcgctaccgcgtgtggggaaattacgtaaagcctttattaacttctgccaatattcctctcgttatcagcgctatttgaacggcgaaaatcccaatacctttaatcccgctttttctaatggttcaatcatggatattggctattactgtctggccagcgccctggcgttatggggagaacccaaatcggtgtgggcaagcgcaagtttactcccaagcggtgtcgatgctcacggtacggtcagtctgaattacggtgattttgatgtcattatcatccactcaaaagtcagccaatcggatattcccagtgaaattcagggagaagatggctcgttagtcattgaaagtatttctgaatgcttatccgtggccttcacgccaagaggaagccattcacaagacctgacgcaaccacagcatattaataccatgctgtatgaagcagaggcctttgcccgtttggtggagaataatcgggtggatcacgatggcttacacctgtcattactgacgtcacgcattcaaacagaaatccgccgccagacgggtgttatattcccggcagatactcaataccccgccgcgagttaatgtttcgtttaaagactgtttgcagatatcggtgcaaaacagcaaccaacaaataaaaggttgcaataaagcaagcggttaataaagcatctaatcacttccacactacaatctatcgatcggggctaccatagccccacatttattttgtatatatctttttttgccaaatgttattacgatcacatcaatgtaaattaaatgttatgtaatattgatccatattagatttttttgattgtctctttcctgctcaatagattcccttatactgtcgaagcaaacacacccagttacaaataataccaagttacaggtgtgaacaataaacgctcagcctcgttccggcttgagcgctatacccaaagtcattggcgttgcagccaggtaataaaaagcgaggcctgcattactggtttatatcagtgattcaggtatggagagcagctagcaccgctgcaacttcaggtaatgaagggtataaacgggcagaacatattaaatttcacttgggaagaggcattgctagaagctatggaaaagacacagtctgtatttatacgatttatcgtcaacggtagtttagtgaaacaaatactgatcggtttagttgccggtattgttttagcattagtatcgactcctgcagcgatagcggtagggttactcggttcgctgttcgtgggcgcattaaaagccgtcgcgccagttttagtcttgatgttggtcatagcatccatcgccaaccataagaaaggccaaaaaaccagtattcgccctattctgttcctgtatgtattagggacattctctgcggcactggttgcggttgtcgtcagttttatctacccatcaacccttattttggtggctgagagtgctgatatcaccccaccgagtgggattgttgaagtgctacacggtttgctaaacagcataatcgccaaccctatccatgcgctgctcaatgctaactacattggtattctggcttgggctgtgggtttaggtattgccttgcgtcatgctgccgataccaccaaagcattgattaatgatatgtcagatgccgtcactttggtggtccgtgtggttatccgttttgcaccgttgggtatttttggtttggtcgcgtccactatcgcagctaccggcttcggtgccttacagctttatgcgcaactgttagtggtattgatcggctgtatgttactggtggcattagtggtcaacccactgattgtttactggaagattcgccgtaatccttatccattggtatttgcttgcctgcgtgaaagtggcgttactgccttctttacccggagttcagccgcaaacattccagtgaatatggaaatgtgtaagaaaatgaacctgaatgaagacacctattcgatctctattccgttaggtgccaccattaatatggctggtgcagccatcaccatcacggtgctgacactggcggcggttcataccctaggcattaccgttgacctgccaacagccctgctactgagtgtggttgcggcgatctgtgcctgtggtgcatccggtgttgccggtggctctctgttactgatcccactggcttgcagcatgttcggcattccaaacgatgtggcaatgcaagtggttggtgttggcttcattatcggcgtattgcaggattcagccgaaactgcactgaactcttcaaccgatgtgttgtttactgcagcggtctgtcaggctgaggatgccaaactggctaatcctgacccactggcagcgggtaagtcagtctaaatactcggttttacctacgcaaaatgccagtcagttaagtttgactggcatttttttgttatcaaatcaggcctttttctcaatctcaaaaggatctattccctgcaattgcagacgacggaaccgaataatattaaagccattcagcagcaagaaactcccttcaatcaatgaaccgccaatcgaacccaaccagacgttatgaataaaccagcaagccgtggatatccacatcacactacgggtcgttagtccgctggtgcggaacagcgcccaagtgctgatcaccgtgccaaaaatcggtaatatctctacggcatgttgcatgcgccatatacccaaagccagtgtcaggatgatgaataccaccatcactctgctactgcgagtcttggtagagatcagagtacgcaacgaattcagcagcgcgctactcccggcagcactggcccccattaggaagaaatggcagccgataatggcgctgtaaacggaaagttgctgtttaaaacgccgctcatcacggttgaagaacatggtgataccgacaaaaaatgccagtacgccaacggcttgagcaaaccaataaaaggtcatggcgggagggtcctgatgtacggttccccgtactgagtctttacaaattaataagcaaacagcgcactccccctacagcttaaagtgtgaaggggaagtgcgtttccataaaaaacagaacgccgtttcatattaacgaaatggcgtattttttacaaggttacaccgctcttaaaaatggctaattcacggaagtcattcacttcattacgggcaggtttaccattagcaatctcaacaatcagatcaacaaactcgttcagcaaggtatccattgaggtgccatggatcagcttacccgcatcaaaatcgatccaatgtggctttttcgccgccagttcactgttagttgccagtttcactgttggtacaaaacctccgtatggtgtgccacggccagtactgaacagcaccatatggcagcccgcacctgctaatgcgctggtcgcaaccgcatcattgcccggcgcactgagtaaattcagtcctgggcgctgtaagcgctcaccatacttcagcacatcaaccacttggctctgacccgctttttgcgtacaaccgagagatttttcttccagcgtggtgatcccccccgctttattacccggtgatgggttttcataaatcggttggtcgtgcgcaataaagtactgtttgaagtcattgaccatgctgaccgttttttcaaacgtggcttcatcacggcagcggctcatcagaatacgttctgcgccaaacatttccggcacttcggtcagtaccgatgttccgtcgttggcaatcacatagtcagagaaacgtcccagtaatgggttggccgtaataccggacagcccatcagaccccccacattccaggccaaatttcagttcacttaactggccgggttcccggcgatcatgacgcatgacctgatacagagcatgtaaatgctctaaaccggcttcaacctcatcatcatgctgctggcaaaccataaagcgtacgcgctcttcgtcaaccttgcccaatgtcgtttggaaaacatctacctgattgttttcacagcctaagccaatgaccagtaccgcccccgcattcgggtgacgcaccatgttttgtagcatagtgcgggtattttcatgatcctgccccagttgcgagcagccaaatggatggctgaacaggtaaacaccatcaatcccttcagcatcctgtgtctctttcaggaaacgttgctggatctgacgggcgatcccattaacgcaaccaaccgttggtatgatccacagttcattacggatccccacttcaccctttggccgacgataaatttgcacgtcacgatcagccatttgtggcggtagagaactgaactctggctgatattcatactcatccaaatcgctcagattagttttggcgttctgtgaatgaatatgttcgcccggttggatcaaggtcaatgcatggccgataggcaaaccatacttgacgatcatctgccccggttcgatagcggttaacgcgaatttatgcccacgaaccacgggctgagccagtttgacgctaaactcaccgctctcgatccgctcatctgcagccagatcttgcagggcaacggccacattatccagcgggtgaatctttataatattttgcatagttaagcctttagctatatgccgcgaccgccgctctcatgccacggctaaggatggtttgcagttgctctgtcacctgattagccagttgaggcaccgcggtcaaatcctgcccccaatggttagcatcagaaagcacgcggttaaccaattcagccaacgcgatatcaccgtgcttgacaccattccacagtgttgaataacgctccagccagtgggcgtcatcctgcaacgggtaggtttggccctcacgttcaccacggtaaaaggcgataagtgctgccagtgcaaaggtcagacgtgggggtaattggcctttttgctgctgataggtcagtaattgcggcaagatacgggtgcggaattttgtcatgccattcaaggcaatcgacagcaattggtgctgaataaacgggttacgaaaacggctcagtaccgcttgagaaaacgacaacaactcgtcttcgggcagctccaataccggaacaatctcttccgtaatggttttttccacaaagcggctgatctgcgcatcatccatcgtctgaccaacggtatccagacccgacaaataggccacggggaccagcgcggtgtgtgcgccattcaagatggccactttgcgttctttataaggtttgatgtcatcgacaatgcgcacattcagatctaactgatctaaacgcagttcttgtgccaacccttgtggcccttggatcacaaacagatagaaatattctgcggtatccaagaagctgtcctgataccccaattctgtttgcaacgccgccacttcatcgcgtggatagccagtcacaatgcggtcaactaatgtcgagcagaaggtattattttcagtcagccagtgggtgaaggcagctggcaactgccaatgactggcataacgcagcaccagttcacgtaatgcttcaccgttatagtcaatcaattcgcaaggcaatagcacccagcctttatctgctgcaccgtcaaaatgctcaaaacgctcaaataataaacgagtcaatttagcagggaaagaacttggcggcgcatcgctgaattgatcagcttcattccaggcaatacccgcttccgtggtgttggagaacataaagcgaatattggcatcacgcgccagcgccagatagtcatcaaactgacgataaatattgatttcacggtttacagagcggatcaggcgggattcacgcaccgcttccccctgctcgttcaggccacggatcacggcagtatataaaccatcctgcgtactgagcgacggtggaaaatcggtgtcaattgggcggatcaccacgatccctgcgttcagatcggtatgttcattcagtaaatcaatttgccagtccacaaaggcgcgcagaaagttaccttcaccaaattgaatgattttgtcagggtggctacggccaggaaagtcacgacggttcagcgtttgcatcagggttcaccttataacgcattcagctttggaccgttcatcactgacagtccgtgctttgcaagcagtccgttctttgcagaaaggtatctaccgcagtgcagccaagcgttaaataaacaatacgttagagttatatggagccaactattggccccgttattaaaattgattgagtgattaaatctgcttgagtgattacagttcgatggcgaaatattgctgcgcattatcgaagcaaatgtttttcaccatcgcccccagtaacgcaatatcggccggtgcttcaccgtccgcgacccagcggccaatcatctggcaaagaatgcgacggaaatactcatggcgggtataagacaagaaactacggctatcagtgagcattccaacaaagcggctcaatagaccaagctgagcaagttgggtcatctggcgctgcataccgtctttttggtcgttaaaccaccagccggaaccaaactgcatttttcctgcttcaccttcgccctggaagttgccgaccatggtaccgatcacttcgttatcacgcggattcaggcagtaaaggattgtttttggcagggcattgcgcagaccctgtgcatctaacagccgagacagcggctgcgccagcggttggtcattgatggagtcaaagccgatatccggccccaccaggttaaacatgcggctgttattattacgtagcgcaccaatgtgatactgctgtacccattcacgacgatgatattcaccagacaagaacagtaatactgcggttttaaactgcgcaatttcttctgtacttggctgattgccagccagacggcgtgccaaaatagcatccagtgtggtttcatccgcctcgccgtataccaccacatccaacgcatggtcagagactttacaaccgtgggcggcaaagtggtccatacgcttattcaatgccacgcacagatcggcaaaacggctgattgaggtatccgcagccgcttcaagccgctgcatataatcgttaaaacccgctgcttcaatattaaacgctttgtcgggacgccagcttggtaacactttgatgttgaagctgccatcagcggcaatcgctttgtggtggcgcagatcatcaattgggtcgtcagtggtcccaaccattttgacattcatctgctgcataatgccgcgcgcagagaaggggtcctgcgctaataattcgttgccgcgttgccagatctcttcagatgtcgccggggacaataacttaccggtaataccaaacggacggcgcaattcaagatgcgtccaatggtacaacgggttaccgatagtgtgaggaaccgtcgcagcccaagcatcgaacttctcacgatcactggcatcgccggtgcacagacgctcagcaacaccgttggtccgcatggctcgccatttatagtggtcacctttcaaccagatgtcatacatgttcttaaaacggtagttttcggcgatctgttctggcggcaaatggcagtgataatcaaagatcggctgatcttttgcatagtcatggtagagacgacgggcgaactcggtgtccagcaaaaagtcttcggtcaaaaactgcgacattatggattcctcagatgagtacatctcagagtacggctttctgttatcgcaaagttatcacaccaattaaatctatcgtccagcatttttatagatattgatcgcaaaaacctaacaaaaagaacaaatactcaacatttatagtctctgtagtcccttgcggcactaggtttgacgggttctattattccctaaattaaacgcagcttttgtgatgtcactcaacttttaaatctgtatgacaagttattgttgcgtcgcctcaactatctcatccgctttgctttacccagcgcgctgatttggtccaaatgggcccatgcctatagatataggccgccaaagtcattgaaattataacgaggaagtaaacgagtcagttctataaaactgattcctacccgcaatacgggagagtgatgcagaggagtgatagcggcttacatcgctacagcatcaaataagaaagagacagtaaaaaaaagaaagctataggtcgtcgctaatggaacacatcggaaacttatcactttactgcaaacggcttaagaccgaagtgatatcgggcaacagcattctgactgaccttatctctgggttatagaatgccgcgccactcgaccctaaaaggagcatcaggtaccaccgcatgcgcagcattgccgggttggaccaaattgtgccatggaacgccaccatcaactgcgtttcattgcagtcatcttagactgggagaaagttacacatgatgcgtaaaattaaagggttacgctggtacatgatcgcattggtcaccgtcggtaccatattaggttacttaacacgtaatgccattgctgttgccgcgccgacactgcaagaacagttacatatcaccacccagcaatattcttatattatcgctgcttattcagccgcttataccctaatgcaaccagtagccggttatgtattggacgttatgggtaccaaagtgggctatgccatgtttgccgttatgtgggccatattttgtatgagtaccgccttggccagcagttggggtggattagctatcgcccgtggtgcggtaggtatggcagaggcggctatgatccctgcaggcctgaaagccagtagtgaatggttcccggccaaagagcgttctattgcggtaggctactttaacgttggctcctccatcggcggtatgattgctccccctctcgtggtctgggctatcgtgatgcacagttggcagatggcattcatcattaccggtgtactcagcctgatttgggccattgcctggttaatcctctacaaacacccgaaagatcaaaaaagactcagcgacgaagaacgtgagtacatccttagcggccaagaagcacagcactccactgctaatgccaaaaagatgtctgcgatgcagattatccgcaaccgtcaattctggggtattgccatcccgcgtttcttggcagaacccgcttgggggacgttcaacgcgtggattccgctcttcatgtttaaagcttatggctttaacttgaaagagatagccatgtttgcctggatgccaatgctgtttgctgatgtaggctgcattctgggtggctacctgccgccactgttccaaaaatactttaaggttaacctgattgtttcccgtaagttagtcgtcactatgggtggggtattgatgattgggcctgggaccatcggcctattcaccagcccttatgcggctatcgcgctgctctgtatcgggggctttgctcaccaagcactgtcaggagcactgattacattatcttctgacgtttttggccgtaacgaagtcgcaaccgccaacggcctgacggggatggcggcctggacggccagtactctgttcgccctcgtggtaggggcattagccgataccatgggcttcagcccactgtttgctgcactggcggtatttgatttactggccgtcgtggttatctggaccgtgttacaagatcgcacagcagatgaaccaacgaacgacccggttcaacggccgccggttggacaaaactgaccttactctctgtaattaaatgacctgcctgtgattaaatgacctactaacatgaaagcccggtaaatttatcgggctttcatctctcctgttatccgcaatctgcgacatattctccatcgcaactatgatagcaataactagaacccaatagggataagtggtataacaaatcctattgtgtctccttcgagatgccataccttccagacaaaatgagccgcaaaatttgccgcctcgattgatcgcaagagccttaatcatggaattcacagaaaccagacggttgtaccagcagttagctgcagagttaaaacggcgtatcgaagcaggcgtttatcctgttggtgataaattgccagcagaacgctacatttccgaagaaatgaacgtcagccgaaccgtagttcgtgaagcgattattatgctggaagtggaaggttatgtagaagtacgcaaaggctccggcatccatgtgatgtctaatcagcaaaagcatttagtcaccaatcaggggattgaatttgataccgctggcccctttgagctattacaggcacgccaactgattgaaagtaatattgctgaatttgccgccacacaggtaacgcggcaagatattgttcaattaattgaaattcaaaaacatgcgcgtcaggaagatcgcttccgtgactctcaatgggatcttaaattccacgtacaagtcgctctcgccacccaaaatacagcgatggcaaccattgtcgaaaaaatgtggagccagcgtacccataatccttactggattaaactgcatgagcacattgatgatgtctcgattgaaagctggtgcgaagatcacgacaagatccttgaagcgttaatacgcaaagatcctcacgccagtaaactcgccatgtggcaacatctggaaaataccaaacagatgctattccgtgccactaccgatgattttgaattcaatgttgatcgctacctgtttacagaaaacccagttgtgcatcttgataacctgatgaacaacagcaaagtccctatcagcagcaaaaattaatcctcatttaatgatgggtaatcagggaggagaaaccggcattattctttctcttccctgtgtaattactccgctttaggtcagtaaatgtcgagttctgtcaaccaacgtcagcatcacacccgtttttaaaccattgcttaattaatactcaatggatatctatatttccctgtttcatatctcgctattttgctaaagtggcaacacttttttatctggttgctttgggagcgaaacgcaaatacatgcgctggttgtttgctctgtttattaccgtgtcttgctgggccagtctggtctccggcaatatgctgttgcctccccattcgaccccatctggcgcagctttatccgcgttgagcaccgtttattctgacaaccactgcgccagttattccctctcatcttttcacgcgctttcagccaagctacgtctacaaaatcaagacgtatccccgcaattgcgtttggtcggggtgccggtcaaaaaaacggcgattaagaatagactgagtgcggcgcaatttacgggctctgcaaatctttctttactgaataacacttggccagcggcttattttgctatctcacgcagccaccgggcggatgatatttataaacaaccacggcaatcgctgtcgctggttaattattccaactggatattccatgcagcaacacagcaaaatcgtgtgggcggttggaaagagagcaatactcaatacagcgggatgcttacctatcaccattatgacgcgatggtttttatgcttgcatagcatcaatgtagccatcatatcaatgtagcctgatatcatgacggttataaatcatgacggttataatccggtattgcacagtaccaacgctgtcatcacgagaagtaaagttacctcttatatatcggcgaattggtctatttggcttacatttcagcacattatttaacaccatcgcttaaacacgaaaagccatcagatctcttcgcaagatcgtgtttataaactaacgtacttacccatacgtatacaaacaatgacgttttaggaataccagatggatatcattaaagaactcttacatgctctatgggctcaagactatgagacactggcggacccatcgctggtgtgggccatctatctactgctgtttgtgatactttttttggagaatggcctgcttcctgctgcctttttaccgggtgatagcctactgattctggtcggggtgctgatcgccaaaggtgcgatgagttttccagtgaccctggtggtcttgaccacggcagcaagccttgggtgttgggtaagttatattcagggccgatggctggggaatacgaaagttgtacaggggtggctgtcccatctgccagcccattaccatcaacgcgctcacaatctttttcaccgccatgggttatccgccctgctggttggccgttttctggcattcgtccggaccttattgccaaccattgccggtctttcaggcctggacaacgcccgcttccaattctttaactggatgagtgggttactctgggtattgatcttgaccaccatgggcttcgcctttggcaagacaccggtattcctgagatatgaagatgaagtgatgttcgtcctaatgttactgccactggcgctgctggtgatcggtttgtttggttctttgtacgtgctgtggcgtaaaaaaaatgcgacgcccgctaaagtcagtcatgacaataagaaaggtaagtcagagtgatcaactttaggggccgttttggccgcccgctctggcactatctggtactgccagtggtcctcttactgctggccgtcatcttattgacaccaatgatcgtacagactgaaagtacgttgaaaattcggccaaaccagcaagggctttcattacctgatggtttttatctgtatcaacatctgaacgggcgtgggattcacatcaaaagtattatcccggaaaatgacagcctagtggtaagcctagagttccccgagcaacagatgcaagcgattgaagttttgcaggatgtcttacccgcgggctatgcgattgtcgccagtgaatcgaaaaaacgtcatcgcctactgcccgtattcagaagtaatcaacaaaacttaggataatcaacgctacggggagtcgactccccgtatcaaactcgttcctctcaccgattttttccgctgatatctgattaatctataaaaaatcccgtggtaaacttgggtatcagataattcagcgctatgcttaatcattcacggcaatctgcttcgcctctgaagttaccgatcaggtggcatgactatcaggcactcatgcgctttgctgtaaaaggacacaatacaatgttgttacgtcgatctctcctgctagctttaccgcttatcacgttttgtggcttcgcgaccgcagcctctgataatgaatgcgatataaaagctaaagaaattcaacagcagatagattatgccaagcagcatggcaatacccgccgcgccgcagggctggaaaccgccttaaaagaagtgaaaactcattgtactgaggaaagtctgcaagccgaacggcagaaaaaaatcagacaaaaacagcacaacgtgacagagcgccaacaagagctaaaagaagctcagcaaaaaggtgacgcgggcaaaattgccaagcaacagaaaaagttagccgaagcacaagccgagctacaacaagcacaatctcagcaacactaatcagtgttaaatgctgagtttctgttattttttggttttttatgccagaaaaatatcgataatatggttaaattttctaaagatttgcctatcaacctcataaaaaatccgctatgttatatattcacctcggttatgcttaaggagtagttacatgccacaagataaaacctctgaacatttacgtgctgaacttaaatcattggcagatacgttggaagaagtgttgcagtcttcaaccgataaaccaaaagctgagttggataagctccgtgctaaggcagaaagcgcattgaaagatacccgagttcgtctgagcgaaacgagtgataaaattgcagcccaaaccaaagagatcgcagataaagcggataactacgtacatgacaatccatggactggcgtaggtatcggtgctgctgttggcgtggtgttaggcgttctgttgtctcgccgttaattatggcagagcaacctcgcactcagggccccgctaaaggggtccttgatactgtccatcgcatcgccactatcgtggttggcatagtcgaaacccgtgtccggctggcagtgattgaattggaagaggaaaaggcaacgttggtccagttgctgatgatggcgggtattactctgctattaaccgctttcggtttaatgagtttgttggttttggtcatttgggcgattgatccagcctaccgtttagtggcgttgggtaccacgactgctgtgttactgatactggcactgatcggtgttatctggacactcactaaagtgcgtcattctacgttgctgggttcaacccgtaagcagttggaaactgaccgcgagttactggagaaagaccattgagccgccaccagctagcattggaaaaagaagcattactgcgtgagatccagcaacaacgtctggatctcgcggacaatgctgctcgttgggttgaagttaccgcgcccttcgatcgtggctgggcacagattgtcagtatgcgaaaatatttgatagcaggcggtagcttggtggccttatacagtgttcgccaccccagtaagttgctccgctggtcacgacgtgcagttagcacctggagtacccttcaactgtttcgccgcacttttttatcacgctaatcccttccccacatccttaccctataggtataggtcttattgttcatcaacttaagatgtttctgttggcttccccccactgctaattcagtttttttgatgaaaaacgacagttttacttgctaacaacctatctacttctcaactaacattatctcatcaactcaggcaacttatgggtaacacaccctgcgggccaccacacatgtcgcttgaagtctgacgggtataaaactctgttgttaacagttaatgctcataaatgttagtcattaatcaacaccgtctttggagaagttatcgatgaacaaattacaagatactggcctgttggtcgctcgcattctcatgccaatcatctttattgtggccggttacggcaaaatgggcgatgcctatgccgggacccaacaatatatgcaagcgatgggcgttcctggctttttcctgccactgaccattttattggaatttggtggtggcctggccattctgtttggtttcctgacccgcaccacctcgctgttcattgccgggttcactctcctgacagcgtttatcttccacactgactttacggatagcactaaccaactgatgttcatgaagaacctgagcatcgcagggggtttcttggtattggcgatggctggcccaggtggttttagcatcgaccgcttactgggtaaaaagtggtaatcagggtttaatcgcgataatgcatgatagttaatatcagcgataccctatccatccggtagggtatttttttaagggggatttcatggggcaactcatcaatggcgtctggaaagacgtttggtacgacacccaatcgaccggtggccatttcaaacgctcaaccgcccagttccgtaattgggtgaccactgatgggcaagcgggtccacagggtaaaggtggttttaacgccgaagcccaccgttaccatctctatgtttccctcgcctgtccgtgggcgcaccgtgctttactgatgcgcaccttgaaaggccttgaatcgctaatttctgtttccgtcgtgcacccattgatgcaagagaatggctggacctttagtagcgactttcccgctgcaacgggcgatgcactttaccacctcgattacctgtatcaactctatctgcgcgccgcaccggactacagtggacgcgtgacggtaccggtgttatgggataaacaacaacaaaccgtggtgagtaatgaatccgcagatatcattcggatgttcaacaatgcatttgatgatgttggtgcaaaagcgggagattattaccccactgcgttacgtaacgatattgatgacatcaatggctgggtttacgatcaggtcaataacggtgtgtataaagcgggatttgcgaccactcaggaagcctatgacgaggccgtgggcacgttattcagcgcattagacagactcgagcagattctgggacaacatcgttatctgaccggcaatcagctaacggaagctgatttacggttatggactacgctagtgcgttttgatccggtgtatgtgacgcatttcaaatgtgataaacggcgtatcagcgattacccaaatttatatggcttcctacgggatatttaccagatgcccggtattgccgaaacagttgattttgcgcatattcgcactcactattaccgcagccacggcaccatcaatccttatgggattatctctatcggcccacagcaaaacttgctggagccacatgatagggcgaatcgctttgtataagaattgatttgtacaagaattgatttatctaattagcacgctaaacgcccttttccccaaggccaagggcgtagcaagcgaacgttgtttgacgcaacctaaacccaaaatccacacgcgcagtagctgatcacttacccaatagcttggggatcttgcgcaaacaccaagacttagcctcccccatactgtcacgccgccacgccataataatatcggcctcacggctgtattccggcccgatcacccgcaaccggcctgcggcaatgtctttttccaccatctcataaggcatggtcgccacacccaacccggctaatagtgcccgccgtttatcttcaatcgtactgacggtcaggcgctgttgtttatccaataattgcaccgtaatgacgggccgctcccgcgcggtatcggctacggcaatcccccggtattttacccgagtcagttccgaaagcggttctggctcttgatgaataggatggtctgggctggcaacgtatacactggtcactttgtacaacttacggctattaatctcagaagaggcgcgaaagtgcatatctggagcaataacgatatctgcccgcccctgttccagccgttcccatgcgccagccagcacctcggtgaggattgatacctgtgtattggctttaagcgccaatttatcaatcaacggaaataatttccaggcaggcgataacgcctcgctgacaatggtgatatgagtttcccaaccacgagccagtgcttcagcatcggtggttaatttatctgccgcttccagtaatacccgcccacgctccagcaacatccgcccgacattagtaaatttggttcgatgtccagaacgatcgaacaacaccacatcaagctcttcctcaagtttttgcatggtatagctgagggcggaagggacccgacccaattcatcagccgccgcagcaaaactgccacgacggtcaatggcatccatgacgcgtaatgcctctagcgttaatgcccgatctctggccattatctttctcaatcaggaaatttgaatatgccgaccagattaactggctaacaatccaacgtccagacgcttaccatctgtttatcaattaatatcatcaataatatgcctaatagatttcaaaattcaggaaagcgaccaacgaatgacaaacgggtcgagaaccggttgccgcagtcttgcagaggcgaaccgatggagaggccgacagactccttcctgtggcttgaaagatgaccggtataagaggtaatcatcgtcatgatcacatgcagaacagcagaacagtgcgggcaggctgactttggttggcttcaggcgcgttataccttctctttcggccactatttcgatcctacattattaggctatgcctcgttgcgggtcctaaaccaagaagtattagcacccggtgccgcattccaaccacggacttatccgcaagttgatattctcaacctgattttacaaggcgaagcagagtaccgggatagtctggggaatcatgtgcacgccaagacaggcgatgctctgttattttcgcctcagcaaggggtcagttacagtgagcacaatctgagtgccaataaatcattaacccgtattcagctatggcttaatgcctgccctgaacgggaaagtgctccaacgcagcaccagagattaagcactcgccctgtgcagttgctcgcctcaccagccggtgagcaaggtagcctacagctacgccagcaaatgtggatacatcacctggcattagcggctggagaacaacaaaagatgccattacacggccacagagcatacttacagtcgattcatgggacagtagacgtcgctggcccgcaaacggggacatcacagcgcctaacgtgtggtgatggggcctttgtggaagaagaacaacacctggtgattaaagcgataaccccactgcgcgccctcttgattgatttaccggtttagttctctcgccgttgcctgataccgatgtattcgctcgcgccctatcctgcaaagcaaaaacccgccaaagcgggattttgtggcatgagtggcgttgaccggtaagccgctttcttttatgaaaagtgtcgtggacagtcattcccctcacgccctatcctccaaagcaaaaacccgccgaagcgggattttgtggcatgagtggcgttgaccggtaagccgctttcttttataaaaagtgtcgtggacagtcattcccctcgcgccttatcctgcaaagcaaaaacccgccgaagcgggattttgtggaatgagtggagctgaccggtaagccgctttcttttataaaaagtgtcgtggacagtcattcccctcgcgccctatcgtgcaaagcaaaaacccgccgaagcgggattttgtggaatgagtggagttgaccggtaagccgggttctgtcgtggacagtcattcctctaggccagcaatcgctcactggctcaagcagcctacccgggttcagtacgggccgtaccatgcgaacccctatttggccttgctccgggtggagtttaccatgccacgaactgttgccagccgcgcggtgcgctcttaccgcaccctttcacccttacctgatcccacttgcgtgggccatcggcggtttgctctctgttgcacttgtcgtaggcttgcgcctcccaggcgttacctggcaccctgccctatggagcccggactttcctcccctccacctgtctcccccgaaagggacggcagtgaagcggcgactgtctagtcaactccgcggcggattataggcacattactgctgaatgtcatcctcttctgtttctacgtcgccttgttgctgttctaaagcgtatttatagagcgcattctttttgactccatgaatttctgccgctaatgcggcggcttttttcagcggtaactctttttgcagtaaggccagtgtgcgcagggcatcggctggtaatgcatcatcggactgtactttatgcccctcgacaatcaaaaccatctcaccacggcgacgggtctcttcttccttaacccaagccagcaattcaccgactggcgctccgtgaatagattcccaggttttggtcagctctctggccagtacaacatagcgttgtgggccaagtacggttaccatatcctgtaagctttctaataagcgatgcgttgattcatagaagatcagtgttcgaggttcctcaatcaacgcttgcagagtatccttacgtcctttagtttttgctggcaggaagccttcgtagcaaaaacgatctgaggcaaggcctgcggcagagagtgcggtaatcgccgcgcaagcgcccggcaagggcacaactctgatgccagcttcacggcaacggcgcactaaatggtagcccggatcgttaatcagtggcgtacctgcatcggataccagcgcaatactctggccttcttgcagtttagccagcaactgatcagctttttgttgttcgttatggtcatgaagtgcaaacaggcgggcgttgatcgcaaaatgctgtaacaacaaccccgtatggcgtgtatcttcagccgcaatcaaatcaacgcctttcagtacctctaacgcccggtgggtaatgtcccctaaattaccgattggggtaggtaccacataaagcgtagatgcagaaattactgctcgatcgtgttgattcattgtttcatccgaattgccgatttaatattgagcatcttgaaaaaaacatcactggatacagtatgctttcctcaacattcgttcgttctaaagcagggcttgttcctgtcattctggctgctcttattttagcggcctgtacaggcgatgcgccacaaacgccgccccccgtaaatatacaggacgaagcaagcgctaactctgattattatctgcaacagttgcagcagagcagtgatgataacaaggctgactggcaattacttgccattcgtgccctattacgtgaggcaaaagtgcctcaggccgccgaacaactcagcactctccctgcaaacctgagcgatacacagcgccaggaacagcaattgctggcggctgaactgttgatcgcgcagaaaaatacgccagcggcggctgatattcttgccaaattagaggcaactcaactctcaactaaccaaaaagtacgctactatcaggcccaaattgccgccaatcaggataaagccaccctgccattgattcgtgcatttatcgctcaggaaccattactgacagataaagcccatcaagataatattgatggcacttggcagtcactgtcccaactgacaccacaagaattaaataccatggtgatcaacgcagacgaaaatgtgctgcaaggctggctggatttactgcgtgtttatcaagataacaagcaagacccagagctactgaaagccgggattaaagactggcaaacccgttacccacaaaacccggcagcgaaaaatctgccaactgcattaactcagatcagtaatttcagccaggcatccaccgccaagattgctctgctgctgccattaagtggcccggcacaagtattcgccgatgccatccagcaaggttttactgccgcccaaaatggctcagcggtaacggcttcagtaccagtaacgccaaatgtgacggaaagcagcccaacggatactgctgcggttgtttcggatgataccccggccacccttccggccccagtgcccccccccgtcgtcaccaacgcccaagtgaaaatctacgataccaacactcaaccactggcagcgctattggctcaagcccagcaagatggtgcaacactggtcgttggccctctgctaaaacccgaagttgagcaactcagtgccaccccaagcacattgaatattctggcgttgaaccaaccagaagccagtaataacagcccaaacatctgttactttgccctatcgccagaagatgaagcccgtgatgcagcgcatcacctgtgggaacagcaaaaaagaatgccgctgttgctggtgcctcgtggtgcccttggtgaacgcattgccaaagccttcgctgacgagtggcaaaaacaaggtgggcaaacggtattacaacagaacttcggttcaaccactgagttgaagcaatccatcaacagtggtgccggtatccgcctgaccggtacccccgttagcgtttctaatgtagccgccgccccggcctccgtcactattgcgggcctgaccattccagcaccgccaatcgatgcaccggtagtgtcaacgtcttcgagcggtaacattgatgcggtctatatcattgcgacgccatctgaattaaccctgattaagccaatgattgatatggcaaccagttcacgcagtaaacctgcgctgtttgccagttcacgtagctaccaggctggcgctggcccagattaccgtctggaaatggaaggtatacagtttagtgatattccgctgatggccggctctaaccccgctttgctgcaacaagcatcggctaaatacgctaacgattattctctggtacgcttatacgccatggggattgatgcctgggcattggcaaatcatttttctgaaatgcgccaaatccctggcttccaagtcaaaggggtcaccggtgatttaactgcatcatcagattgtgttatcacccgcaagctaccttggttacaatatcgccagggaatggtggtgccactcgcataattcagtcacattcttctcatatgttgtagagaatgatgtcatagagaatgatgtggtagaaaatattgtcgagtgattaaggattttagggactatcgatgagccaacgggatactggcgcacattacgaaaacctggctcgtcgccatctggagcgagcaggtctcgtttttcaagcggccaatgttgccttccgtggaggcgaaattgaccttattatgcgtgatggggatgcatgggtattcgtcgaggttcgctttcggcgcaatgacctgtttggtggtgcagccgccagtatcaccccgcgcaagcaacaacggctacatctggccgccgctgtttggctggcacaacgcggcgccagttttgccacaacatcctgtcgttttgatgtagtggcgataaccggtaaccagttagaatggctacccaacgctttcaatacggattgatgtttattttccaattgataccgagctatacccaaataattcgagttgcaggcagacggcaagcgagagaaaaattggtctggaaccaatttgaacagcatttatgctgtccgcagggtgggcctcagggataaggctcattaattccgatgagcttactgactttaaagtcaacgaccagtaagtgattcgggttattgagcgtcgccaacgcacatacagcttgaagtatgacgggtatattaattttactgaatgggttaaatcaacgtgctggaaagaatcaaaggctgctttactgaaagtattcaaacccagattgcggcggcggaagctctgcctgatgctatatcctgtgcagcgatggcgctggtccagtcattgctcaacggcaataaaattctctgctgtggtaacgggacttctgcagcgaatgcacagcattttgctgccagtatgataaatcgctttgaaaccgagcggccaagtctgcccgctatcgctctgaatgccgataatgttgttttgacggcgatcactaacgatcgtttacatgacgaggtttacgccaaacaagtacgggcgctcggccaggccggggatgttttgctcgctatttccactcgtggcaatagccgtgatattgttaaagcggtcgaagcagcagttacccgggatatgaccattgtcgcgctcaccggttatgatggcggcgaactggctggtctgttaggtcagttggatgtcgaaatccgtattccttcacaccgtggagccagggttcaagaactgcacatgctcacagtgaattgtttgtgtgacttaattgacaacactctatttcctcatcaggacgattaaaggagcaccaatgaaggttggttacatatttgccatgctattcagcaccctacttttacagggctgtgtcggcgcagtggtcgtcggtagtgcggcggttgccacaaaaaccgccacggatccacgtaccatcggtacgcaggtagatgacggcacactggaagccagggtcgttaatgccctgagcaaagataaggaaatcaagagccaaacacgatttgtggtcacggcttatcagggaaaagtattgctaaccgggcaaaccccatcagcggagctgtctaaccgcgctaagcagatcgcctctggtgtcgatggtgcaacggaagtctacaacgagatgcgtttggggaaaccggttgatctgagcaccgcgtcaatggatacctggatcacaaccaaagtacgttcacagctactcaccagtgattcggttaaatcctctaacgtcaaagtgacgacggagaacggcgaagtcttcttattgggcttggtcactcaacaagaagcgcaatcggcggcacagatagccagcaaggtcagcggcgttaaacacgtcacgacggccttcactattgttaaataagatcctgttttaaagaagattaaataagatttatcacgggcttagcgctaaaccgccaagcccgttttttatccaccacatcgatacccaatatcatgagtcttacaggcagccggtgagtcaacaccaacgagcttgccccagcccgcaatttaacccagagcgacaaactcccgcagaaatatcaaagtcggagggtatcagcgtcaatccagcgtattttcctgcaagaacgttttgccccctaactggtgcatctggcgcaaaatccattgttggcgagaaataacataaccagacggcgcattaaccttaaagcgaagtggattcggcagtactgccgctaataatgcggcttccgaggcacttaatttgctggcgggcttgttgaaaaaatggcgcgcggcagcttcgaccccaaagataccattaccaaattcggcaatattcagataaaccgttaggatacggcgcttcgtccatatcaattcaatacccgcagtcaatccgacttccaaccctttgcgtacccagctacggccatcccaaagaaacacgtttttagccgtttgttgtgacagcgtcgatgcaccacggatacgcttttgattgcgctgattatgggacagcgctgattcgatggcaccgacatcaaacccccagtggtcagggaacttttgatcctccgccgccatgacggccaacgccatatagggtgaaatttcatccatgggcacccaatcagagtgggcaacataagcgaaatcaccggtcagccaggcacccagttgcctttcgatcatgaccatagaaaacgggaccggcaaaaaagcaaaaatcagaataccggccatccacagcgcaataatgccgataacaccccgtttcccccaataccaaagctgacttaatccccgcctgactgagatcattcagttaaatccaagactttcgtcactaatttatcaatacctttagccgcttctgaaatggaaccagccaacatgtaagccggtgtcgtcaccactttattttccaaatcaatgacaacgtcatcagcagggcaaataacatgctccccccccataatttcaatggcatcaatcgtatcgggatcgttaccaattgtcagtcgaatgggtttgcccagcagcttcggcagcatcaccggagaaatacacatcaatccaattggtttaccggacttatgcattaattgaattaacttatataaatcgggttcaacggaacattcgccccctttaatggcgaagtcgcagaggttctttgctgccccaaaacctcccggtacgattagtgcatctaatacctctggatcagccgcagaaaggggggtgatcaggccacgggcaatgcgggcagactccactaaaacgttccgttcttctgcaacaatctcaccagtaatatgattaataacatgaagttgaggtttatctggcgcaaaaaacaaaacctctgcgcccgcgcgatccaatgccagcattgttaagacagactcatggatttcagcgccatccaaaacaccacatccactgagcactacgccaactgttttcatctcgtttctcccttatcttcctctgtcaatcacttaacccgttctagtaacaaagaccaatctctatcacaaattttaatgaatcttgtaacaagagcgcttacatttgctatgttgttgctagtatgatgtatgaaagaatcctgacaacctgcgaattcactcgaaatcgaaataatacgcaggttaacgttttccctggtgttgacgcagtcttcgcgcaccccggcctcggtcggggttattttttttcaacttccgctgcccactcacgcaatacctgaacatcattacgccattctaattttaactcatcgacccagtcctgcacgttatcccaccacgctggcaatgtcggtgtctgaatctgttgggccagttgctgtatgtggcgtaaaccgacagaacctgccgcccctttaattttgtgtgcttcttccgtgatccccttttggtcccgcgccgtcatatttgaatccagcaccgccaaataacctggcatcatctgttcaaacatctccagactttggtgaatcaactgtgggccaactaaatcgatgtattgttccaacatggtggtatcaagtaacgattcatgggtttgcatcactttatgctcctgtttttgtaccgctgaagagggcttactatcccaaaattgcttaatcatggccgtcagtgcagggactgacagtggcttactcagcacgtcgtccatgccggcatctaaatattctttcttatctttaagaacgttagcggttaatgcgaccaacgggggcaatgactgcttgccatattccgcccgaatttgccgggcgatatccagcccgctcatatcaggcaactgaatatctaataaaaccaaatcaaaatcttcagggttaaacatggctaatgcatcgtggccattcatcgccacgtcaacactgttccccaatttttccagaactgaacgcgcaacaatgacgttcagctcgatatcttccaccagcagtacatgaagagcaggtaatggcatatcgtcgcctgacggcgcgttggaggcttcctgtaccgcaggtgccttgatggttaaggtgaagcaagaacccaccccctgcgtgcttttcaccgtaatatcaccgcccatactctgtgccagacgtttagataccgcgaggccgataccggtgcccgtggccgggcgccccccgttgcgatctttcacctgataatacatggcgaaaattttatcttgttcgtcttccggtatccccatgcctgaatcttcgacttcaaaaatcaggcggtcgttaccctcacgccgtacccgcaccacaattttgccttgctgggtgaatttcaccgcattaccaatcaggttccacaggatttggcgcagccgggtcccatcggcaatcactttctccggcaatggcaactgcggttccataatgaatttcaatccttttggctgcaccagtaaaccggagaggttttccagatcggccatgaacccagtaaaatcaacaggttgattatcaagctgtactttccgccgctccagcttatccatttcaatgatatcgttgaaaatatttccaagagtgatagcactgacatgaatggtttttaggtatttcagttgttcggcatctaattcggtatctaacaagatgcgactgaggccaacaatgccattaagcggcgtacgtagctcgtggctgattgttgagataaatgtcgtcttatccctactggcattctccagcgcgtcctggtagcgcttacgctcggttatatcgcgtccaaagcccattagcccatgtcgtttaccgactcggtcataaaaaggcactttacgcagttcaaaacaggctttacggccatctgggtaaaccagccactgttcgtaggtaagagaaacgttatggcggaagactttctcatcggtctccatcactttctcggcgatatccggtgcataaacatcttttggcgtcaatccgaccagttgcttctcacttttacccgtcaacaattccattgcgcggttacaaccggaaaactcattatcttcgttacggtaataaaccaaatctggcgaggcatcgagaaaagaacgtaataaggccgattgctgccccagctcaatctgcgcctgctcgcggtggcccatctcttctttcagtttatcgaccacttgcagatgcgctttctctgctttttcgcgttcaacaatctcttgattcagttgagtaatattttctgtcagttgcttgttcagctcgagatcgcgatgacgcatcacttcgagcttatcaaccaaccgggatagacgctggcgcgactcttccagttgctcaaccacaaccgacaggaaatacacggcccaaggggttatcagcaaaccaaagaaaatggagcgcaccagatcgagggtttcaacagagccgcgcaagacgaaggtgacggccatttgaacaaccatcgccaataacaccaatgccgatgccagtagcagcgaaaaacgcaccagccctaatttaaccattaaatcaacatagtactgggctaatacccggatttgcttcatagcaacctctgtcagtgcttatcggataaatcataccgtaaaaccacaaagagataagccaggtgactcagaagtgtggaaaagattgcaaatcgcgggggagatattggggaataacgcgtttatggacctgaacagtaagcaaacaacagataacaccagccaatagatatcccctccaacggtaataatgagtattttagccatagcaataagcattttagccatagcaataagtctgttaaccatggcgattactctcttagctattacgataagtatcttaacgatagcaataagcatccccaatcgcggtgccctgtacgccatgctggagtaggtaattattcagctcattcatgcctgtccaacgattctcacaccacaagggggccagcaatgtagggcgacgcgcactggcagaaatccgatgatagacaacctctgcgggtgtatggcgaatcatttcacctgcggtgaggacataatcctccaacgccaacgccgttaagcgccccgcccgccaggctttcgccatcgtactgccttccacgatatgcagtggatgcagttttatcccatcaacaccggtggtgaccactttttccaaggtttccctcccctgcgcccgatcctctcctggtaaacccacaattaaatggcaacacactttcaggccacgagcgcgagcacggcgggccgtttgctggtagcaagcaaaatcatgtccacggttaatacgtttgagtgttttatcattagctgtttgtagacccagctcgagccaaacttcataaccttgttgctgataactgctcagcaaatccagaacggcatcgggcacacaatccgggcgagtacccacgcacaggcccacaatatcagcctcacacaatgcctgttgatacattgcagctaacgcattcacctctgcataagtactggtataggcctgaaaataagccagataacgattcgctcgattggcttttttggcctgtatcgcgagttgctgagtgatactttgttgctgcatttgctcatcagcaaaggaggcaacctgacaaaaagtacaaccaccacgccccagagttccatcacgattcggacaactgaacccgccatgcagcgtgagtttatgaattttttcaccataacggcgctgtaagtccgcaccaaacatattgactaattgctgtaactgcatgatcttggcactgcctgtcaaaaagagcccatacccaaagccattggcgttgcggccaagcagcaaacgaacgaaatcctgcagatctgaattaagtcagtaaaccggataagtgagggccgcgaataccgctgtaacgtcaaattaaggggggtaagcctaacccgccgccgatgccgtgtgcgatgacagagatcaactcccacgcttttgggtgcaatcctgcataaccattcatcataaatgcaaataaaaccacttgaccgattattaaattttcttattcccaccaagcccttagcgcttctattacaaatcagtgaaaaatagttttaacatctaataaataaaaaaaattcagtctataattctagcatccccacccgcactagcattgtgcagagatttgacgattacactatagtgagacagctcacatatttgtgtctgcttcatgaagcagccgacaggtataaaatgcaaataaatcaatattattcataatgataagagcatttattaccataaagatatatctcatgcttatatttgacctgcgtattctttctcgctaagttggaagtccgctggaagctttctagacgggcaaacgtctagtcataattatgcagtaatttaagactccctcttaaaacaagtcttttaccacttgtgagaaccatcacgagaggccattggcggagggcggaaaagcagatttgccgcaaaatacgcgtctgtcagcccacactgtctgatatcaatatgtcctttacgagctggtttgtgagagtctcacagagcctggggaggttcactgatatgttgtatgatcaatcccaagagagggacaactgtggtttcggcctaatcgcccatatagaaggcgaacctagccataaggtagtgcgcaccgcaatacacgcactggcccgtatgcaacaccgtggcgcgatccttgctgatggcaagacgggcgatggttgtggcttattattgcaaaaaccggatcgctttttccggatggtcgctgaagaacgcgggtggcgtttggccaaaaactatgccgtaggtatgatgtttctcagtcaggacgaagaactcgccaaggcaagccgccgcattgtagaagaagaattgcaaaatgaaacgctgtcgattgtcggctggcgtgaagtgccgacgaacccagatgtactcggtgaaatcgctctctcctccctgccccggattgaacaaatttttgtgaacgcccctgcgggctggcgttcgcgtgatatggaacgtcgcctgtttgtggcacgccgccgtattgaaaagcgtatttcagataaagatttctacgcatgtagcttctcgaatctggtgacaatctataaaggcttatgtatgcctgcggatttgccacgcttttatcttgatttggctgacctgcgcctcgaatcggcaatctgtctgttccatcaacgcttctcaaccaataccgtcccccgctggccgctggctcagccgttccgctatctggcacataacggcgaaatcaacaccatcgccggtaaccgccaatgggccaaggcgcgtgcctataaatttaaaacgccattaattccggatttacaggatgcggcccccttcgtcaatgagaccggctctgactccagttcgctggataacatgttggaactgttcctcagtggcgggatggacttgatccgtgcaatgcgtctgttagtgccaccggcctggcagaacaacccagatatggatactgatctgcgtgccttctttgacttcaactccatgcatatggaaccgtgggatggccccgctgggatcgtgatgtctgatggtcgctacgcggcctgtaaccttgaccgtaatggcctgcgccctgcgcgctatgtcatcaccaaagacaaactgattacctgtgcctcggaagtcgggatttgggattaccagcccgatgaagtggttgaaaaaggccgcgtgggtcctggcgaactcatggtgattgatacccgcagcggtaaaatcttgcattccgccgaaacagacaacgatctaaaaagccgccacccgtataaagagtggatggagaagaacgttaagcgtctggtgccgttcgaagacctaccggaagaacaggtagggagccgtcagttagatgattcgcagttggaaacttatcagaagcagtttggttacagcaacgaagagctggatcaaatcattcgcgtgctgggtgaaaacggtcaggaagccaccgggtcgatgggcgatgacacgccatttgccgtgctctccagcggcccgcgcattatttatgactatttccgccagcaatttgctcaggtgactaacccccctatcgatccactgcgtgaagcacacgttatgtcactggcgaccagtattggccgtgagatgaacgtcttctgcgaagctgagggccaggctcaccgcttgagctttaaatcgccgatcttgctttactctgattttcagcaattaaccacgctggaaggggaacattaccgcgctgaccgtttagatctgacgttcaatcccgcagagaatgacttggagcaagctgtactgtcgctgtgtgatgaagcagagcgtaaagttcgtgatggtgccgttatgttggtgctatcagaccgtgccattgcgcctaaccgcttgccggtgccagcccccatggctgtcggtgcaattcaaacgcgtttggtggacaaaagcctacgctgtgacgcgaatattattgtcgaaaccgccagcgcacgtgatccacaccacttcgcggtgctgctcggttttggtgcgacagcgatatacccttatctggcttatgagtcattggccaaactggttgattcccaagcgattgataaaaagtatcgcgatgtgatgctcaattatcgcaacggtatcaataaaggactgtacaagatcatgtccaaaatgggcatctcgacggtggcctcttaccgctgtgccaagctgtttgaagcggttggtttgcatcgtgatttgtctgatctctgtttccagggtgttgtcagccgtatcggcggggccagcttcagtgatttccaacaggatttacagaatctgtccaaacgcgcctggctgaaacgtaagcctctggatcaaggcggcttgctgaaatttgtccacaacggcgaataccacgcctacaacccagatgtggtcagtaccttacaaaaagccgttcatagcggtgaatacagcgattatcaggcgtacgccaagctggttaatgagcgcccgattgccacactgcgcgatctgttagccattaaaccgcaaggcactccgattcctgtggatcaagttgaaccggctgaatctctgtttaaacgttttgatactgctgcaatgtctatcggtgccttaagcccggaagcccatgaatcactggctatcgccatgaacagcttgggaggtttctctaattccggcgaagggggcgaagatccggcccgttacggcaccaataaggtgtcccgtatcaagcaggtggcctctggtcgtttcggtgtaacaccggcatatttggtcaatgcggatgttatccagattaaagtggctcaaggagcgaaacccggtgaaggcggccagttaccgggtgataaagtcacgccgtatatcgccaaactgcgctattccgtaccgggtgtgaccttgatctccccgccaccgcatcatgatatttattcaatcgaagacttggcccagctaattttcgatttgaagcaggtcaatccgaaagccatgatttcggtgaaactggtctctgaaccgggtgtcggcaccattgcgaccggtgtcgccaaagcttacgccgatttaattactattgccggttacgatggggggaccggtgccagcccgctgtcttcggtgaaatatgccggttgcccatgggaactgggtctggttgaaacacaacaagcattggtggccaacggcttacgccataagatccgcctgcaagttgatggcggcctgaaaactggcgttgatattgttaaagccgctattttgggggcggaaagcttcggttttggtaccggccctatggtggcactagggtgtaaatacttacgcatttgccacctgaataactgcgcgaccggtgtggcgacgcaagatgaaaaattgcgtcgtgaccattatcacggcttaccggaacgcgtagtgaactacttccacttcatcgcccgtgaaacccgcgaaatcatggccgaactgggcgtgagtcaactggttgatttaattggccgaaccgatatgttgctggaactggatggcatctcagcgaagcaaaacaaactggatctgtcgccaatgctgaaaacagcaacgccacatccgggcaaggcgctgtattgtactgaaagtaacccgccgttcgataaaggcttactgaacaaagagttgctgtctcaagctgaaccctatattgaagccaaacaaagtaagacgttctattttgatattcgcaacactgaccgctccgtcggcgcagcattgtcgggggcgattgccacgaaacatggcgatcaagggctggcaactgatccgatcaaagcgtatttctccgggactgccggtcagagttttggggtgtggaatgccggtggcgttgagttgatgctgactggcgacgcgaatgactacgtcggtaaagggatggccggtggccgtatcgcgatacgtccgccagtcggttccaacttccgcagccatgaagcgagcatcattgggaacacctgcctatacggtgccaccggcggtaaattgttcgccgcaggccgggcgggtgaacgcttcgcggtgcgtaactccggggcgatcacggtcgttgaaggtatcggtgataacggttgtgaatatatgactggcgggattgtctgtgttctgggccgtactgggattaactttggtgccggtatgaccggtggcttcgcttatgttctcgatgaagacggtgaattccgtaaacgtgttaaccctgaactggtagaagtgctggatgtcgagcaattggctatccatgaagaacatctgcgcgggctgatcactgaacatgttcagttgactggctctagccgtggcgaagagattctggctaactggccagaatgggtgaccaagtttgccttggttaaaccgaaatccagcgatgtgaaagcactgttgggccaccgtagccgttccgcagctgagctgcgggttcaagcgcagtaaggagttgatatgagtcagaacgtttatcagtttatcgacttacagcgcgtcgatccgccgaaaaaaccgctgaagatccgtaaaattgaatttgttgaaatttacgagccattctcagaaacacaagccaaagcacaggccgatcgctgcctgtcctgcggcaatccgtactgtgaatggaaatgcccggttcataactacatccctaactggctgaaactggccaacgaggggcggattatggaagcggctgatctggcacaccaaacgaacagcctaccggaggtctgtggccgtgtttgtccacaagatcgcttgtgtgaaggatcttgtactctgaacgacgaatttggtgccgtgaccatcggcaacatcgagcgttatatcagtgacaaagccattgcgatgggctggaaaccggatatgtcacatgttcaccctaccggtaaacgtgtggccgtgatcggggccggccctgccgggctggcctgtgctgatgtattagcacgtaacggtgttcaggctgtggtctttgaccgccatccagaaattggggggttactgaccttcggtatcccagcgtttaagctggaaaaagaagtgatgattaaacgccgtaagatcttctccgagatgggaattgaattccaactgaatactgaagtaggcaaagacatcaccatggaagcactgctgaaagattacgacgccgtgttcctgggggttgggacctaccaatctatgcgtggtggtttggaaaacgaagaggctaacggtgtatatgatgccttgcctttcctgattgctaatactaaacagctaatgggctatgaagcgacggctcacgaaccgtatatcaacatgcaaggtaaacgcgtcgtggtgcttggtggcggtgataccgcaatggactgtgtgcgctcctcaattcgtcagggggcaaccgatgtggtttgcgcctatcgccgcgatgaagtgaatatgccgggttccaagcgggaagtgaaaaacgcccgtgaagaaggggtagaatttaaattcaacctgcaaccattaagcattgaagtgaacagcaatggcaaagtctgtggtgtcagaatggtccgcacccagttgggcgcgccagatgcacagggccggcgcatggctgaacagatccctggctcagaacatgtattgccagcagatgccgtggtgatggcatttggtttccgcccacacagtatggaatggctggccgctcacgatgtgaagctggataagcaaggccgggtgattgcaccggaaagcactgataatgccttccagaccagtaacccgaaaatctttgcgggcggcgatattgtccgtggttccgatttagtggttaccgccattgccgaaggccgtaaagccgcagacggcatcatgaattatctggaagtctaatgcggtagatccccaaatcattcaataaacactagggcgggttcaattcacagaacccgccctttgaggttattgacaaagtgcctgcaacggagagaacaggcagatcgtaaagacgccataaacccttccctgggggctcgagccgcgccctccctggcgcggacgctttactcttctgcctatcctcaccgttcaagagtgagtcatcggggtttgtcagcagtctggccctttctatttatgcacgtctattgttgtatacacctattgttgtacacgtctattccctcatttccacttctgagtttccacatacttctcaatcacacactctcattaagtgaatacatttatagcgtacatgcattctgcacgcctatggacatcaataaatgattggggaaacgcaggtggtcaacgcctaggcggcttgaagtaggatggacattacccaagattttgtaacaatatcaaatagccttattttcagtattttatccacgatagcgctatagtgaaggcttggttgttaagtgcaagcccctcacaactggcatatactgtcacactttgctttaaataaaggataatctgttatgaaatttcacttaccttttattgttggcggattactggcgatgagtagcagcgcattcgcaatgtctctaaattatcaagaagttggctacaatattgaggcgcggggcgcacgtgcagtggttgccgaactggagaaatcggggcaactgccagcggttgagaataatattaagcttggtgatgataactggattgctatggcacccaaattagccagtgccggtaatgcgaagtttactgaaggggtgaaatctgccctctcctctgccctgatttataacccggcagcggtattaaaagcagtcagtggcagtaaaatattaacattatccgatgtttgcactgcacctatagatgtcaaagacagtgaggcaaaagccaacttccagcagcgagcgtcacggacattattgaccatcaagaacagtgacatggcaggcccacgtgatagctgcctggctgagctcaaaaaactgtcgtagcaattatcaagtaaatgaaaaacagccatcaagtaaacgaaaaaacgctaccaacagccagctaatcaagattcccgcacaaaacagaaacgataagggcggctaacgccgccctgaagagatagagcctgtatttatccgaaccgcgaaaattacttaaccacgcgtaatgccgggcggccaccactccgtggcggttgcggcggcttatcatccggtgaattgtcatcatcctgctcaacgcgggtatcatcagttaccaacatcaagctctcagtcggtgctgtctcgttctcttttccttcgatgccctcaaaattaccatcagcatcagcatcataagccgcttctggctcaaacatcgtacctgagccattttcgcgcgcataaatcgccattaccgcagcaataggaacggtaacctgacgaggaacaccaccgaaacgagcattgaaacggacatcatcattgctcagttccaaattacccaccgcacgcggtgccacattcaatacaatctgcccatcacgggcaaactccatcggcactgaaacaccaggacgggtaacatccacaaccagatgtggagtaagttgattatcaatcaaccactcataaaatgcgcgcaacaagtaagggcggcgcggagacatatccgacatctccatgacaattagctccgagttttcagatgcatttcacgttcagcttcagtcagtgaagccaagaacgcatcacgctcaaagacgcgagtcatatagcctttcagctctttagagcccgcccctgtgaactcaatccctaacaccggtaaacgccatagcaacggagctaagtaacaatcgaccagactgaactcttcactcataaagaaaggtgtttcgttaaagactggcgcgatggacagtaactcttcacgtaactgtttacgtgccgcttcagcttcctgtgcattaccttgctcaattttatacagcagggaataccagtcgtgctcaatacggtgcatcatcaagcggctgctaccacgagcaacaggatagactggcatcaatggtgggtgagggaaacgctcatccaaatattccatgataatgcgggattcatacagcgtcagctcgcgatcaaccaaagtagggacagtacggtaggggttgaggtcaatcaggtcctgtggcaggttatcagcttcaacctgctcaatctcaacactgacacctttctctgccagtacgatacgtacttgatggctaaaaatgtcggtcgggccggaaaacagcgtcattaccgaacgtttgttggcagcgacagccatgaaaacctccaagtttatctagaaaacagtgcgaatagcccacggttaggttgctatcctgggtcgttttaccaccggttcgcaatctcgaccgctgtgccgtaaatgagccttggacgagataagaattcagccagggagatacacggacgtcaacagttcgccgaacaggcacaaaagtggttggtagtgtaccagattttgcatgttttgtggggatggtgctgcgatttcatgatgaattgtctatccgacaacagtttaacgcccagaagggagcgtataaaatggcaggtacgtgtttttcaggcataaaaaaacccggtgagacaccgggtttttaccatcaatctgatgccgtaaaggcaaaaaattaacgtttggagaactgtggacgacgacgtgctttacgcagacccactttcttacgctcaacttcacgcgcatcacgcgttacgaagccagctttacgcagttcaccacgtagagactcgtcatactccatcagtgcacgggtgataccgtgacggatagcgccagcttgaccagaaataccaccacctttaacagtgatgtacatgtcaaacttagtaaccatgtctaccagttccagcggctgattaactaccatgcgggcagtttcacggccgaagtaaacttctaggctacgttggttaataacgattttaccgctacccggcttaagaaagacgcgtgcggaagaacttttgcggcgaccagtgccgtagtattgattttcagccattgccataatcccgattaaatgtccagaacttgcggttgctgtgccgcatgattgtgctcagtacccgcgtaaactttaagcttacggtacattgcacgacccaacgggcccttcggcagcatgcctttaaccgcgatttcaatcacacgctcaggacggcgggcaatcatctcttcaaaggtcgcttgtttgataccaccgacgaaaccggtgtgatggtaataaatcttgtctgtacgcttgttgccggttacagcaactttttctgcgttcagaacgatgatgtaatcaccagtatcaacgtgcggggtgtattccgctttatgcttgccgcgcaggcgacgagccagttcagtagcgaggcgacctaaagtcttaccgctcgcgtcaacaacataccagtcgcgttttacagtttctggtttagctgtgaaagttttcattaaaagcttacccaattaataagttacacgttggtgaacacccaaacgttcaaaaacagttgaggctcacacgaccatcagtccagcaaacctaccccttcgaatagccaatgctggcactatcaaagtttttgggaaaaaaactttgttgtaacgtggggtcgcaagattatagagaagtcggcgttaaagatcgaactgtttttcacgagaaaggtataaattaaacatgttaagtacggacgacaaatgtcgcccgccatagaatagcatttaagccgcccaaaagtgaaccattgtggcgcaatagcccttaaggtaaatggggtaaagaaaggtactcttcgctttgcatctcttgtaatcgcgataaacaacgctggtactcaaacttaaggcgctcaccgctataaatctcaaacattgaggcttcagccgcaataatcagtttcacccggcgttcataaaactcatctaccaaggccagaaaacgccgtgccgtgttctcatcgcgggccgccatgcaacggacattgtggagcaataccgtgtgatagcgcttagacaaagcgatataatccagttgactgcgcgcttcttcacacaatgtatggaaatcaaccgccagcaccccctcagccacacaaatcgcaggcaaaggccggtgattcacctccaacaccgttgcctttcccccttctttccccgcaagtttaacgaaaatcgctgccattgcttgttcggtctgtgaatttaacggggtcagataaagattagcctgagtcaatgtccgcaaacgataatcgatacccgcatccacgttcatcacctcacaatgttgcttaattaaggcgatagcgggtaaaaaacgcccgcgctgtaacccgttatggtacagattatctggcggaatattagacgtcgcgaccagtgtgatgcccctggcaaatagcgcttccaataatgttgccaacaacatggcatcggtaatatccgagacaaagaactcgtcaaaacacagtacgtcagtctgggccttgaaaccatcagcaacaatttccaatggattttcatgcccttgtaactcggtcagttcttgatgtacccgcagcataaaacgatgaaaatggaggcggagtttgcgctcacccggcaaactgtggaaaaacaggtccatcagccaggttttcccccgccccacaccgccccacatatataacccctgaacggggcttacgggtggtcgtcgagctggcttcccaaataaacggcccaggcggttgcgtaaacttgcactggccgcagggacattttggtactgatttagcgcctgataaattgtctctagccgtgctacagcacgccgctgcacatcatcaggttgatagccgccggcatcaagtgcctgctgataaagcgttataggtgaactctgttgcatgtttatccgcaatccctgataaaatagttatcgacttttcgctacgctttcttactgatttttcgggaaatcgtagcatttaccgactccgcaattgcggaaaaaacctgataaccagaggtaacattgcatcaggattccactcagacaaggttaacggttatagtgggtattattaagtgaaaaagttctgctgaacaatgaagtcaaaaaaggagtcatcatgacctgggagtatgcgcttattggattggttgttggtgttgtgatcggcgcggtggctatgcgctttggcaaccgcaaattgcgtcagcaacaagtgctgcaaaatgagctggagaagagcaaaacagatttggaagagtatcgtcaagagctggttgggcacttcgcacggagtgccgagttactggataacatggcccgtgattatcgtcagctttatcaacatatggcgaaaagctccaataacttattaccggacttaccattacaggataatccgttccgttaccgtctgacagaatccgaagcggataatgatcaggcacccgttaaactgccacctcgtgattactctgaaggcgcatctggtttattacgcccggaacaccagaatcgcgattaagcttgtgtttaaacatctatactcactgcggtggggcacatctccgttccaccgcaactcactacatttacacttctatacttgcctctccttgaattgctgtaacgcggcccttatatcaaacgacatcaagggtgtttacttttagaccaatactatccttttgaaatgagcgaatttttttgctatttacgggtctgaatttatacagacttgtgagcgtcatccaccctattcattcaccgttaggtattgagagagtttaaatcaatgaagaaaacatcattacttcttagtgcgctagcaataagcgtcggcttaggtctcgcttctgttcctatggtgagtgcagcagcactgcctgcggcggtcgccggacaaacgttacctagcctggcaccaatgctggaaaaagtattacccgccgttgtcagtgttcatgtctctgggagccaggcacagcaacaacgcttgccagaagagtttaaattcttctttggcccgaatgcaccatcaggaaaagagagcagccggccattcgaaggcttaggatcaggcgttattattaacgctgagaagggctacatcctgaccaacaatcacgtcatcaataatgccgataaaattcgtgttcagttgaatgatggtcgtgaatacgatgcaaaattgttgggtcgtgatgaacaaaccgacatcgctttactgcaattaacggatgctaaaaatctgactgcgatcaaaattgcagattccgataacctgcgggtgggggattttgctgtcgccgtaggtaacccgtttggtctagggcaaaccgcgacgtcaggtattatttcagcactgggtcgtagtggcttgaatctggaagggctggaaaactttatccagaccgatgcctcaatcaaccgtggtaattctggcggtgctctggtgaatctggatggggaactgatcggaattaataccgccatccttgcgccaggtggcggtaatatcggtatcggcttcgctatcccaagtaacatggcacaaaacctcagccagcagttgatcgagtttggcgaagtgaaacgtgggctgctcggtatccgtggtagtgagatgacggctgacattgcgaaagcctttaatattgatgctcagcgtggggcttttgtcagtgaagtgctgccaaaatcagcggcagcgaaagccgggatcaaaccaggtgatgtgttgatttccgttgatgggaaaaagattagcagctttgctgaattgcgcgccaaagtcgggacaacggggccaggcaaaaccattaaaattggtttactgcgcgaagggaaaccactggaagtatcggtgacgctggataacagtagctcaacatccaccagcgctgaaaatctatcgccatcattacagggcgcatccctgagcaacggtgagctcaaagacggtagtaaggggatcaaagttgatagcgtcactaaaggttcgccagccgcacaatctggcttacaaaaagatgatgtgattattgccgtaaaccgcgaacgggttaaggatattgctgagttgcgtaaagccatcgaagccaaacctgccgtgattgcactgaatatcgtgcgtggtgaagataatatttacttattaatccgctaatttgcagaaaaatcggacacagcacgatgctgtgtccgcctaactcatgctattctccttttcacccattcatttatgccttaaacctcatgtttcttaagctattgcgttctattattttggggctaattgttgccggtattctgctggttgccctacccatgctccgcagcccaggttatttattctctggaaaaagcaataacgtaaatgaagaggttcctaccagttataaccaagcagtacgtcgtgccgcaccggcggtggtcaatgtctataaccggagcctgagcgctacacagcaggggttagccatccgcacgctgggctcgggtgtgatcatgagcgataagggctatatccttaccaataaacacgttatcaatgatgcagaacagatcattgtcgccatgcaaaatggccgtatctcagaagctttattggtcggttcagataatctgacagatttagccgtcctaaagattgacgcaacaaacctgccggtgatccccattaatattaaccgcacaccacatattggtgacgtcgtgttggcaattggtaacccttataaccttgggcagacagtaacgcaggggattatcagtgcaaccgggcgtattggtttaagctcttccgggcggcaaaatttcctgcaaacagatgcatcaattaatcagggtaattccggcggtgcgctggtcaacacccttggcgagctaatggggatcaacacgctctcatttgataaaagcaataatggcgaaacaccggaaggcatcggctttgcgatcccaacagcactggcaacgaaagtgatggaaaaactgatccgtgatgggcgggtgatccgtggttatatcggtattaccggcgaggagtacccaccgtttaatgctaacgataatggctcagatcgggtacacggtattaaggtcaaaaaagtttcaccagacggcccagcggcccaggcaggaatacacgttggcgatatcattcttaacgtgaataataaaccggcaacctccgtgatcgaaactatggatcaggtcgcagaagtccgccctggtacgaccattcctgttttactattacgtaatggtcagcagatagcggttcaaatcaccatcactgaactcgatcagaatgagatgctgaccacccaagcagcagattaacgcgcaagcagccaatacccgtgtcacttaacggtatgacgggtatgtataaagaataatgggtaccttgacgccgatgaatataaacataaaaaatgccagccccaatcaccggctggcatttttatttaccgaacacgacccgctttttagcgatcagctttctgtcgatctgcggatttactcgcctttcacgcgttcaatcttcgcacccagcgcccgcagtttatcttcaatacgttcgtagccacgatcgatgtgataaatacggtcaacgattgttacgccttcagcgatacaaccggctaataccaggctggcggaagcacgtaaatcggttgccataacctgagcaccagaaagttgttcaacgccatagcaaatcacggtattgctctcgatttctgcatgtgcgcccattcgaataagctctgggacgtgcataaaacgattttcgaaaatggtttcagtgatgacacccgttccttcagccaccagattcaataaactgaattgggcctgcatatccgttgggaagccagggtgtggcgcggtacgaaaggtaatggctttagggcgtttaccctgcatatccagactgatccaatcatcaccgacttcaatatcagcacctgcttcgcgcagtttagccaagacagcatccagcgtgtcagggcgtgtttggcggcacaccactttgccacctgaaatggctgcggcaaccaggaaagtaccggtttcgatgcggtcaggtagcacacggtatacgcccccccctaaacgggtaaccccctcaatggtaatgcggtcagtaccggcaccactgattttagcacccagcgtattcaggaagttcgccgtatcaacaatctctggttcacgggccgcattttcaatcacggtcgtcccttccgccagtgttgccgcactcatgatagtcaccgtcgcacccacgctgactttatccatcacgatatgagcaccttttaggcggccattaacggaggccttaacgtagccttcttccagcttgatttcagcacccagttgttctagacccgtgatgtgcaaatcaaccggacgtgcgccaatcgcacaaccaccaggcaaagaaacctgaccttggccaaaacgggcaaccagtggccccaacgcccaaatagaggcacgcatcgttttcactaaatcgtaaggcgcacaaaactcattaacagcgctggcatcaacaaaaacggaaccattattacgttcaattttagtgcctaactggctgagcaacttaatggtggtatcaatgtcttttagctttgggacattttgtagctctaccggctcttctgctaacaatgctgcaaacaatatcggtaacgcagcatttttcgctccggaaatagtgacttcaccgctcaggcgagtccgcccctgcacacgaaacttatccattgtgaccactcttggttgttgtcaaatcttgttgtcaaattcgaattcgctgcccgcctcagccactgtttactgctaacggtaaatggctaccacagtaaatgactactacagtaaattaccatcacagtaaacagcgtttagccaacagccttaaaagccatttagtttgcgatcccgctgccattcttgtggcgtataggccttaatggataaggcatggatacggttatcggcgatatattccatcaatggcgcgtaaacagcctgctgtttcttcactcggctcatgtcggcaaataactcacccactacaatcacctgaaagtggctaccgtcaccggtaacatgagcttcctgcaatgccaatgcattcatcagcacgtctttaatttcgttagtatccataagattcattctattttaagaggatcataatcaggcaaacatattagtggaatacggcaagctctgaaactaaagaaaagcccctgtgatgccattatgcacaggagcttgattatcttaccttcggacttaacactacagcgatgctaactggccgtttccacaggaattatctgctggaggttgtacaattcaatcaacgttgccagccggttactgataccgataatctccagagaatggccgcgctggctttgtaactcgcgaaaatgcactaacagagccagaccagacgaatcgactcgttgtaattggctaacatcaatacggctcttatctgccagcaaggtttcacgctgttgccaaagcggtaacagcgtttcacgatccagttcaccttgcagtaccagtgtttcctgcagagactgccagcttagctcacccgccataatgactgtttatccctataatttatctaaaatgactatttatctaaggtgattggctgtttagccgcactcagcaattgttgggtcaaaccatccacacccttttggcgcaggatagaggcccattcattctgtttggtgctaatcatgctcaccccttcggcgatcatgtcataagcctgccagttaccggtttggctatttttacgccattggaaatctaaccggacaggtggacgcccacttggatcgagaatggtgacgcggatagcaacgatgttggcatcccctaaaggctggtctggtgccacatcgtaagtttggccgtgatacagcgccaatgcctgcccgtatgcctgctccagatatttaccgaatgcattgaaatacgcttcacgctgtgcaggtgtagcatctttataatagctacccagtactaacgcgccggcgtatttgatctgaacaaacggcaacagctcttcgcgtacaatggtgcggagataatctggattttgcttaatcttaggctgctcatttttcagacgcgtaaaggttttcttcgctgcctcatccatcagacgataagggttgctttgatcgacagcatgaaccagtggtgctatggccaacaatgcgaccatgaatagacgtttaaacattcagatgccctcttaaggatgttgagcgggaagagaaggtaccgcagcctgtggagctgcagtttcagttgccggagccgtttcacttactgccgggctatcaccgctgctcttgtacaggaactggccgatcagatcttccagaactaatgcagacttggtgtcttgaatggtgccgccatctttcaaaatactggtgcccatttccggatcttcaaaacccacattcagtgccaggaattgctcgcccagtaaacccgatgtgcgtacagccaatgagctggtatctgggatgtggttatagcgttgctgaatatctatcgcgacgcgtggcgtgtagttcttggtatccaaggtgatttccgccacccgccccacaactacgccaccaattttgacaggagagtggttttttaagccgccaatattgtcaaaattcgcgtaaatacggtaagtgggttgattgcccactgacttgatatctgcaacttttaggcagagaaatacgactgccagaatagcaatcagtataaacattcctacccagacttcacttttcttcgtttgcatcgactcagttcccaaacatcagtgctgtcagcacaaaatccaatcccaataccgccagtgacgaatgcactacagtacgtgtcgttgcccggctaatcccttcagacgttgggaccgcatcataaccattgaacagcgcaatccaggtcacggtaagagcaaataccagactcttaatcaggcaattcagtaaatctgtacgccactccaccgcattttgcatcgctgaccagaagaaaccactgtcgatccctttccaatcaacgccaaccactgaaccgccccaaatacccacagcaacaaaaatagctgtcagcaatggcatactgatcagaccggcccagaagcgaggcgcaaccactcgccgtaaagggtcgatagccatcatttccagacttgagatctgttcagtggctttcattaggccaatttctgcggtcagggcagaaccagctcgccccgcaaacagtaacgcagtgaccacaggccccaattcacgcagcagtgataaagaaaccatcatgccgaggctggcctctgcgctgtacgtggtgaggatcaaaaagccctgtaaacccagaaccataccgatgaacaaaccggagaccacgataatcaacagggattgaaccccaacgctgtacagttgtttgattaataatggccattgtttgcgcggttcaggccgcccgacaagggcattgaacagcatcaagcctgcgcgaccaaatgaggcgcaaacattaattcctcggcgacctaaagatgctaacgactttactaacatgaatactccatcagcccatccccttagtgtttgatgctatagggggattcgctatgttcactcacctgaatccattacctgtagtagattttacttatagataagttcatcgggattatgtgcctcaccagaggctcccctgcgggccagctcaagcgccgttcaacatggtttataaccaatttgtcgttcgcttgttacctggctgcaacgccaattactttgggtataacaactcggttttataatcgcctgcggggaagcggaaaggtaccggcccgtcggcaataccatcgaggaactggcgcacgcgcatgtcgctattggtttgcaactgctcaggtgtcccctctgcgataacatgctgatcagcaactatataagcataatcagcaatactgagcacctctggcacatcatgggaaaccacaacgcatgtgacccctaacgcatgattcagctcatcaatcagttttactagcacccccatggtaatagggtcttggccgacaaaaggctcatcaaacatgattaattcaggatcaagggctatcgctcgtgccaatgccgcacgccgtgccataccgccggacagttctgcgggcatcaagttggccgcaccacgtaacccaacagcttctaatttcatcatcaccgtactgtgcagcaactcttcaggcaaacggctatgttcacgtagagggaaagccacattctcaaataccgttaaatcggtaaataaggccccagactgaaacaacatgctcattttcttgcgaacatcatacaaacgctgacgcgaaagtgctggaatattatcaccatcgaaccaaatttcaccggtatcaggtgccaattgtccaccaatcagacgcaatagtgtggtttttccaatccccgaaggccccataatcgcggtcactttgccgcgggggacggtcatattgatgtccgcaaatattagccgctcaccacgggtaaaactcatcccacggatctctatcaaattcatcacattcgatgccagttgtttcattattattcatcccttaaggccttttacgactgatccgtccgttaatgctacatcaaatgacggtgacaagcgtagtcagaagcattttggcaacttattaacgctttttcgtcgccaaagttgccatctgttttacttttctgatactcacagtcaaaattagggggtaaacaacaaagagattgaaagtatattttttaatcacttctgcctacggacaacctttgccaacgcattgggattatacctaataaaggactctgcatgtttcttgcgataacactattaatcattggcttggttttattagtgtatggcgctgatcgattagtttacggtgccgcagtgttatcccgttcttttggggtcccccctctcattatcgggatgaccatcgtcggtattggtacatcgctaccggaactcattgtttcagttacagcggcattgaatggccaaacggatatggcggtgggtaatgtgctcggctccaatattaccaacctattgctgattgtaggaggggcggcacttattcgcccgctgattgtacgctcagagattctgcggcgggagttgccactgatgctcgtggtcacggcgttatgtggttttctgctggcagataaccacctcagccgcggagatggtgtcatcttgctcttggctgctgccgcttttattgttctgatgctcaaaatcgcacgcctggctcatgcggaagggaatgatatcttaacccgtgaacaactatctgaattaccacaagatagtagcactaccgtggcgttgttgtggctcgtattagccttcattattttaccgctctccgccaagatgattatcgataatgcgacggtcattgcccgggtggccggtgtcagcgagttggtcattgggctgacagtgatcgctatcggcaccagtttgcctgaactggctaccttcatcgccggtgcgttgaaaggtgaaaatgatatcgctgtcggtaatatcatcggctccaacatttttaatattgtgattgtactcggtgtgccagccctgctgtcgcccggtgagatcaatcccgaggctttccagcgtgattattgggtgatgctcgcggtcagtgtggtgttcacccttctttgcctgggccgtaaacatcgaatcggtcatctggcaggcgctctgttattatgtgggtttatcacttatcttgcggtgttgttttttgctcccataagtgcgctgtaaaatacatttccctataaatttcaatgctcaggaaggcttggagcgaaagcaaccaacacacctacagcgtgaaagatgacggtaataccaacattgggcggatattaagtatgtctacttttgatttacagccgggcgtggatttccagcaggcaggtaagcaggtacttcagattgaacgcgaagggctggctcaactcgatcaatacataaacgaggatttctccagagcctgtgaggccatttttcgttgccacggcaaagtcgtcgtgatgggaatgggcaaatctggtcatattggctgcaaaattgcagccacattcgccagcacgggcacacctgcattttttgtccatcctggtgaagccagccatggcgatttgggcatgatcacgccacaagatattgtattagctatctctaactctggggaatccaacgaaatcctcacgttgatccccgtgcttaagcgccagaaaattctgttgatttgcatgagcagtaaccctgagagcaccatgggtaaagcggccgatattcacttgtgcattaatgtgccacaagaggcctgtccgctggggctagcgccaaccaccagtacgactgcaacactggttatgggggatgcgttggcggtagccttgctcaaagcacggggtttcacgcaggaagatttcgcactctctcacccaggtggcgcgctggggcgtaagttgctgctgcggatcagcgatattatgcatacgggtacggagatccccaccgtcagccctgatgcatcattacgtgatgccttgctagaaattactcggaaaagtctgggtttgaccgttatttgtgacgattcaatgaggattaaaggtatctttaccgacggtgacttgcgccgggtatttgatatgggcattgatctgaataatgcaaaaattgctgacgtcatgactcgcgggggtattcgagtccctccgaacatattggcggtggacgcgctcaatctgatggagtcacgccatatcactgcgttgctcgtcgctgatggtgaccaattactgggtgtcgtacatatgcacgatatgctgagagccggtgttgtctgacagtttagttgagtcaatgagcgccgcgaacaatgctatcagtcagtgattcgggtgagtgagtgccgctaccaatgttgtaacttcaacaacgttgcgatttcaagaacgctgcaacttcaagtaagaagggtttacccaaagtacttggtgtggcagctaggcagcaaacgaatgaatcccgatgagctgacaccagtcagtgattcgggtgaatgagtgccgctaacaatgttgtaacttcaagaacgctgcaacttcaagtaagaagggtttacccaaagtacttggtgtggcagctaggcagcaaacgaatgaatcccgatgagctgacaccagtcagtgattcgggtgaatgagtgccgctaacaacgctgcaacttcaagtaagaagggtaagagttaatgagcaacaccgcatatatagacacatgctacgggccagtggccgatgacgtaatacaacgtgcagcaaacattcgtctactgatttgtgatgtcgacggtgtcatgtccgatggcctgatttatatgggcaatcaaggcgaagagctgaaagcgttcaacgtgcgtgatggctatggtatccgctgcctgataacctcagacattgacgtcgctatcattactggccgccgggcaaaattactggaagaccgtgccaacaccttaggcattacccacctttatcaaggacaatctgataagctggtggcctaccacgaattattagctaccttacagtgtcaacccgagcaggtcgcttatattggtgatgacttgattgattggcccgtaatggcgcaagttgggttatctgttgcggtggcagatgcccatccgttactgttacccaaggcgcattatgtgactcgaatcaaggggggccggggggcggtacgtgaagtatgtgatttgatattattggcccaagacaagctcgaaggggccacaggattatcaatatgagcaagacaagacgctggataacactggtactggcactgattgcgttagccttgattggctggaatatgtcaggttttaatcaacaaggtgcgccagtagtggctgatgataatgagccatcgtcgcaaagccagcatacggtaacgactgtttttaatccggtcggtcaactgaattacaagttagtcgccgaagaggttcagaattttagcgcgaaggaactaacttggtttaccaaaccggtcatgaccctgtttggtgacaatgcggtggcaacttggacagtgcgcgctgatcgcgccaagctgactgatgataaaatgctttatctgtatggtcatgttgaggttgatagcctgaccgccgatgcgcagttaaaaaaaattcgaacggataacgcccaagtgaatctaattacccaagatgtcgcctcagacgatgaagtgacccttttcggtattggatttacctctgaaggcatgagaatgcgtggtaacttgcgggacaaaaccgctgagctgattgaaaaggttaaaacctcttatgaaatccaaaaataaaataagtcatcttttacttgcctgctcacttttagccgcaagcctgtctgcattcgcattaactggcgatacagaacaacctgccgaggtcaaatccgacaaacaaacattggatatggaaaccaatacggtcacctttattgataacgtggtgatcaaacaaggcacgatcgagatcaaagccgataaagtggtcgtcacgcgccccggtggcgatcaaagtaaaatgatcattgaaggctttggtaatccagtcaccttctaccagatgcaagatagcggtaaaccggtaaaaggccatgggcagaaattacgttacgaaatcgctaacgactttgtggtactgaccggcgatgcctatctggaacagctcgatagcaatatcaaaggcgatcgcatcacttatttggtgaaaaagcagcagatggaagcctttagtgataaaggtaagcgcgtcactaccgtgttattaccgtctcaattacaagataaagggccagcagcatcaggccaaaagaagagtaagtaatcatttatggcaacattaatcgcagaaaagctggctaaggcgtacaaaggccgtaaagtggtcgaagacgttagcctaaacgtgaagtctggggaaattgtgggcctgttagggccaaacggtgcaggtaaaaccacgactttttatatggttgttggtatcgtccaacgtgacgccggccgtattgtgattgatgacgaagatatcagcctcttgccccttcatgaacgtgcgcgtcgtggtattggctatttaccgcaagaagcctcgatttttcgtcgcctgagtgtctttaataacctcatggcggtactggaaatccgtaaagatctgtcggcggaacagcgcgaggaacgggctgaagaattgatggaagagtttcatatcaaccatctgcgtgacagcctggggcaatcactttctggtggtgaacgccgccgtgtggagatagcccgcgccttagccgctaatccaaagtttattttgttggatgaaccatttgccggggttgacccaatttcagtgatcgatattaaaaagatcatcaaacacttacgcgacagtggcctcggtgtactgattaccgaccacaatgtgcgtgaaactctggatgtttgtgagcgggcttacattgtaagccaagggcatctcatcgctcacggtacaccgcaagatattttggctgacgaacaggttaaacgcgtgtatctaggtgaagagttccgtctttgaacccacgcacctaatttggctcctctgttggtcgtccattaaggaaaattgatacagcattatgaagcaaggtctgcaactcaagttcagccaacaactggcgatgactccgcagcttcagcaagctattcgcttgttgcaactttcgacgcttgaactccagcaggagattcagctcgcgctggagagcaacccccttcttgagcaaacggaccttcatgaagagatagatgctaaggaaaccgtggacagtgaatcgctggatacccgcgaagcactagaacaaaaggatatgccggaagaattaccgctagatgccacctgggatgagatttacaccgcaggtaccccatccggcatgggcaatgattacagtgacgatgaactgcccgtctatcagggtgaaaccacccaaacactgcaagactatctgatgtggcaggtggatttaacaccgttcactgagaccgacgccgccattgcgacttctatcgttgacgctgttgatgacactggctatctcactgtgccgctggaagatattctggaaagcatgggtgatgagaacgtagcgctagacgaagtggaagcggtactcaaacgtattcagcattttgatcccatcggtgtcgctgcccgtaacttgcgcgaatgcttactggtacagttatcacaatatgccaaagacaccccttatttggccgaagcgcgtctgatcgtcagcgaatatttagatttgctaggcaaccatgatttccgcatgatgatccgcttgagtcggctgaaagaagatacacttaaagaagccatcgcgctgatccaatcactggatccacggccaggtcagtcgatcaataccggggagtctgagtatgtcatcccggatgttctggttcgtaaagagaaaggtatctggacggtggagctgaatgccgatagcatcccacgtctaaaagttaaccaacaatacgcagcgatgggcaatagcgtccgtaatgacagtgacgggcagtttattcgtagcaatttgcaagaagcaaaatggttgatcaaaagccttgaaagccgcaacgaaacgctgctaaaagtagcaagatgtattgtagaacagcaagtcgagttctttgagaaaggtgcagagtttatgaaacccatggtactggctgatatcgcccaggctgtggatatgcatgaatcaacaatctctcgagtgaccacgcagaaattcttgcacagtccccgagggatttttgaactgaagtatttcttctctagccacgtcaataccgatagtgggggcgaagcctcttctacggcgatccgggcgctggtgaagaaattagtggcggcagaaaaccctgccaagccattaagcgacagtaaactaaccactttattatgtgaacaaggcattatggtagcacggcgcaccgtcgcaaaataccgagagtcgttatccatccctccgtctaatcaacgtaaacagttggtttgacctgaactgagaaggaatagactatgcagctcaatattaccggtcatcatgtcgaaataaccgaagcattacgcgagtttgttaccacaaaatttgccaaacttgagcaatattttgatcgaattaaccaagtatatgtggttctaagtgtcgaaaaagtaaaacaaattgcagaagcaacggtacatgtgaatggaggcgagttgcacgcaagctcggaacaagaagatatgtatgcagcaattgatattttggttgataaactggctcgccagttgaacaagcataaagataaattgaaacaacattagaagcccttgttgctgttattactcagcaaaggttctacactcgctacatagccagataccggtggatatttattcccaccggtatctggcgtaaaacagcgcttaagtgaaagatgagatgaccaacgatccagcattgcaattaagctcggtactcaatatcgagagcaccaaaagctccgtacactgctcaagtaaaaaacgggctttggaaattatcagcgagttagctgccaagcagcttaatctaccttcacaggtcgttttcgatgcggtattgacccgtgaacgcatgggcagtaccgggattggcagcggtatcgcaatacctcatggcaagttggaagaggatacactgcgcgcggtgggtgtatttattcgtctggaacagcctattgcctttgatgcgattgataaccaacccgttgacctgttgtttgccttgttggttccagcagaccaatgtaaaactcacttacatactttatctttagtcgccaaacgattagctgataaaacagtgtgtcgccgcctgcggtcagcacaaagtgatgatgagctttatcagattattactgaattaccgccagaaatagcctagtttggggccaatacgcccaatagacttcaatgtgtaggaaggcggtaaaaatagcgtaagacagtaaaaatgtaggaagacaggaaaatagcgtaaggcagtaaaatatagaaaggcggtaaatggcaaatagccaggcccgaagaatttacataagtcagtgattcgggtagatgagagtagccaacacacctgcggctcgaaagagggtgggttccgcacccaccacactccggtttgtagccggaatgcaggttcctaattatggcgataaacgccaaagagataccaaggggagtgactacatggtgctgatgattgtcagcggccgttccggttcagggaagtctgttgctttgcgtgcattggaagatatgggcttttattgtgtcgataacttgcctgtggttctgttgccgcagttggcaagtacacttgccgataggaacatctccgccgccgtaagcatagatgtgcgcaatatgcctgaatctcctgaggtatttgaacatgccatgacccaactgccggacagcttttccccgcagttgctatttttggatgcagaccgtaataccctaattcgtcgctacagtgatacccgtcgcctgcacccactgtcggcgaagaacctatcgttagaaagcgcgattgatgaagagagtgacctgctagagcctctgcgctcgcgggctgacttgattatcgatacctcagaaatgtcagtgcacgagttggctgaaatgctgcgtacccgcctgctgggtaaacgtgagcgtgagttgaccatggtatttgagtcctttggctttaaacacggcattcccattgatgcagattatgtcttcgatgtccgtttccttcccaacccacactgggatcccaagctacgcccaatgaccggcctggataaacccgttatttccttccttgatcgccatacggaagtacataactttatttatcaaacacgcagctatttggaacagtggctgccaatgttggaaaccaataaccgcagttatttgacggtcgctattggttgtaccggcgggaaacaccgttcggtctatgttgctgaacaactggccgattatttccgcgctcgtggtaagaatgtccaatcacgccatcgtaccttggaaaaacgtaaacaatgactgtcaaacaaaccgttgagatcaaaaacaagctggggatgcacgccagacccgcgatgaaattgttcgagctggttcagagttttgatgcagaagtgatgttacgcaatgacagcggtaccgaagcggaggccagcagcgtcattgcgctgctgatgctggactcagccaaaggccgccaaatagaggttgaagcaaccggggttgatgaaattcaggcattggcagcggttatcgagttgtttaattcgggatttgacgaagattaagggcgcacgcagtgtaggtaatcgtttgctaagcacgaaaaagacgatctttactccttgcagagaaatcagacgcgagtataattcgccacaatttgccgggggaaatgatgaaaaaccgcctatattttgttgaacaacatgcaattgatcatcgacaaaatcacctgcctgcgggcagccaactgccgtggtttctcccgttgctaaaccgatcctgtaaggcccctcgttgaggggcttttttttgtctgtcgaacagaaccaagttaagcattacgactcattaaaataagggtagcccgcgaccacgggtaagcacagaggagagcaaaaaatgaccaatccgttgtatcacaaacatatcatctcaattaacgatttaagtcgcgatgaactagaactggtcttgcgtactgccgccagcctgaaaaagactccgcagccagagttgttaaaacataaagtgatcgccagttgcttttttgaagcgtcgacccgcacccgcttgtcatttgaaacatccattcaccgcctgggtgcctcggtcgtgggcttttctgatagcagcaatacctcattgggtaagaaaggcgagacactggcagacaccatgtcagtcattagcacttatgttgacgccattgtgatgcgccatccacaagaaggggcttcacgtctggccgcgcaattctcggggaatgtgcctatcgtgaatgccggtgacggcgcaaaccagcacccaacacaaaccctgctcgatttattcactattcaggaaacgcagggccggctggataacatcaatatcgccatggtaggtgacctgaaatatggccgtaccgtgcattcattgacgcaagcgctggcaaaattcaatggcaaccacttcttctttatcgcccctgatgcgctggcaatgcccgcttatattttgcaaatgttggaagaaaaagagattgagtacagcctgcatgaaagcctcgaagaggtggtgccggagttagatattctctatatgactcgcgtacagaaagagcgccttgacccatcggaatatgccaatgtcaaagcacagtttattttgcgctcttctgatttaacgggcgcacgggataatcttaaagtgttgcacccgctgccacgtattgacgaaatcacaaccgatgtcgataaaaccccctacgcctactatttccaacaagcgggtaacggtatttttgcacgtcaggcgctactggcactggtattaaacgcagaattagctctttaaggggaatgatgatgactcaggattacaaacttcaggttgaagcgattaaatgcggcaccgtgattgaccatattccagctcaaatcggctttaaattgctctcactgtttaagctaacggcaaccgaccagcgcatcaccattggcttgaatctgccgtctaaacgttctggtcgtaaggatctgattaagatcgagaacactttcctgaccgagcaacaagcgaaccagttggcaatgtatgctccagatgcaaccgtcaatcgtatcgataactacgaagtagtgaagaagctgaccctcagcctgccagagcgtatcgatgcggtactgacgtgcccaaacagcaactgtatcagccacaacgaacccgtcgactccagctttaccgtcaaagcgcagcgaggcgaaattagcctgaagtgcaaatattgtgagaaagagttcgatcacctggccgtactacacgctgattgataacggtaagcccgtaatattcatcccaatgggcagtggctaacttcgccccacgggttgctgtaattcagttcgcctttataatggtcgggatcattatgatatccctttccgcattacgtaaatcaggagtcaacatgtcacgtgttatcagtactgaactcgcccctgctgctattggcccttatgttcaaggtgtcgatctgggcagcatgatcatcacttccggtcagatcccggtcgatccaaaaaccggcttagtcgctgatgatattgccgctcaggctcgtcagtcactggaaaacgtgaaagccattgttgaagcggctggcctaaacgttgccgatatcgtgaaaaccaccgtattcgttaaagatctgaatgatttcagtaccgttaacgcaacttacgaagccttctttacagaacacagcgccccattcccagcccgttcttgtgttgaagtggcccgtttacccaaagatgtaaaaatcgaaatcgaagccatcgcagtacgtcgttaatccctcccccatcaccacatacggctggttatcgccagccgtatgtggtgattttatttctctcctctctgtctctctcttcccattccatgaccgaatctccgttgacggctttaaaaaaagcagggactatcgggctgcggacaagatcagatgaaggggatacaggccgttggatggtagatacaaacgacatcagtcacccaatcgccccaccctttgatcgccgcgttatcacacggatacggttcagttaccgcattcgtatactctgtagcctattgagagggaattaaggatgaaactgcgcacttggttattaataccgataatatgctcaccttttttttggggaagtaccgcaatagccaaaaatggcgtcgccatcccattacctgataagcgagtcgctgtgttgtctgagggcgatttagaatcggcatctgtcggcacctattctgtcgctattttcaagaatgacacttttttggactttattgctggcggagtgttttctcgtgatggttcgatattccaagataatggaaaacctcgggtagaatttactgatatcaatggtgatggcaacaaagaattgatcgtctcccaattgactgctggatcaggtaactatttgcgggttgatgccttcagcctgggaccggatagtatcaataaagtattgagtattcaatcagataccaaaagtgattatatatcactactgaaagaactttgtgagatctgtctgcccatcgatgctcccccccactgatggttctgcattcaaattcagttcacccccaataaaaccaaaccacataatcgatatcaccgcagtaaaaaataccctaacggtgagaaaattcgttagggtattcctatgctgccagtcatcggaatatcatgcgtgccatctggttctatgcatctcgaacttcccaatgccactgcatatataaataatgagtttaaaatgtattttcaaacctgaacattaggcaaaccatgcaaaaccgtttgaccattaaagatattgcccgcatgagtggtgttggaaaatccacagtttcacgggtattaaataatgaaggcagcgtcagcccacagacccgtgaacgggtcgaggcggtgatccgccagcacggttttaccccctccaaatcggcccgagccatgcgtgggcaaagcgacaaagttgttggcatcattgtctctcgtctcgattcgccatccgagaaccaggcagtacgtactatgttaccgctgttctatcaacaaggttacgacccgatcctgatggagagccaatttgataccacattggttagcgagcatttacatattctgcaacaacgccatgttgatggcgtgatcctgttcggtttcagcggattaactgcagaaatgctggcaccgtggcaggaaaaaatggtggtgctggcgcgcgagtaccgtggtttttcttctgtctgctatgacgatgaaggtgccatatacctcttgatggacaaattacgccaagccgggcaccgccatatcagttatatcggcgtacaatcttccgatgcaaccaccggtatgcgccgctatcaagcctatctcgattacagtcaacagcatggcctgacaccaatggtggcgctgggggagttgagctatcagagtggctttcagctcgctcctcaggtgataaccccacaaacctcggcattggtttgtgcctctgacactatcgccatgggcgtcagtaaatacttgcaacagcaggagcgggagcagccccccattcaggtatgcggtattggtaatacaccgctgttacactttttgtttcccgataccttaaccattgagctgggttatggccgtgcaggtgtgaaagccgcgcagcaattactggaccaactgagtaatagccaacctattcagcaaattattattccgggccaacttgtctgatcccatcctgtacagaggaataacgctgcatcgatggccttaacagtgaacaactgtataaaaatttatcaatttgtgatcttcaatacaaaatgggaacgttcccattccataaaaataaatacctagctaatctttattaagttggatatttctccgcctatatccaacgtcattggtgttgtaataagaccgaaaaccgatttgaacagcatgactgctcgcccataaggtgagccttaaaaatgcgacgcattaatcctgatgaactgactcagcgtcgtcatttgggtgagtgagcgtcgcggtaacaccgagtaaaaagggaattatagatttaattcgctgctgacttcaggcagagatggcatctcatgcgcgcacgtaacctttacggaaaggacgataaaatgggcaaagtaaaacagcaggatatcgatcaactgatcgttctggtgggaggcagagaaaatattgccaccgtcagtcactgcattactcgattacgttttgtattaaaagatccgtcgatagcatcaccaaaagagattgaaaatctctcaatggtcaaaggctgttttactaatgcaggccaatttcaagtggtcatcgggccagaagtcgatgattactataaagcattgattgctaagattggccaaagtgaagtggacaaagaacagaccaagctcgcggcacggcagaacatgacttggtttgagcgcggtatttctcactttgctgagatcttcttcccgttgctaccggcgctgatcagcggagggttaatcctcggcttccgtaatgtcatcggtgacatcccaatgtctgaggggaaaacgctggcgcagatgtaccccgcgtggcaaaccatttatgacttcctctggttacttggcgaagccatcttcttctacttgcctgtcgcgatctgctggtcaacagtgaagaaaatgggcgggaccccggtattggggattgtactggggatcacactggtctctccgcaattgatgaactcctacttactggggcaacaactgcctgacgtctggaacttcggttggtttaccattgaaaaagtgggttatcaggcacaggtgatcccctctattttggcgggtctggcgctggggtggattgaaaccaacttgaagaaaatcatccccgcctatctctacctggtggtcgtccctgtggtctccctgctgctagccgtgttcctggcccatacactgattgggccgtttggccgcatgattggtgacggtgtggcatggggcgtgaaggcggtgatgaccggcagtttcgcaccggtcggtgcggcactatttggtttcctgtatgcaccgctggtgattactggggtacatcagaccacgctggctattgatatgcagatggttcagagcatgggcggcacaccggtctggccattgattgcgttgtccaacatcgcacaagcttcggcggtactgggtatcatcatcatcagccgtaaaatcaatgaacgtgagatttcagtacccgcagcgatctccgcctatctgggcgtgaccgaaccagcaatgtacggtatcaacctgaaataccgtttcccgatgttatgcgccatgatcggttccgcactggctggcctgatttgcgggttgacgggagtcatggcgaacggcatcggtgtgggtgggttgcccggtattttatctatccaaccgcagttctggggaatttatgccgtggcgatgttagtggccatcgtggtgccattagcactgaccattctggtgtataagcgtaaagagcgtcgtggcgaattgccagtctgaagggtgtcgatctggatgatgtcgatataagttgtgttctcccgccagcggtgatcgtctggcggggtcatttttcaatgaataagagtccgctatgaataatccaatcccttggtggcaacatggtgtcatctatcagatttacccgaagagctttcaggacagtaccggtaatggctatggtgacctggcaggcgttgcgcagcggctggattatctgcaaaagctgggcgttgatgccatttggctgacaccggtgtatgtctcgccacaagtggataacggttatgacgtggcggattactgcgccattgaccccgcttatggcacattggatgactttaaacgtttggtcgcgggtgctcatcagcgaggcatacgcatcattatggatatggtgttcaatcacacctccacagaacatgcctggtttaaagcttcgcaggatcgtaatagcccttatcggcaattttatatttggcgtgacggtgacggtggagacggcagtttaccgaataactggcgctcgaaattcggtggtcacgcatggcagtggcacgcggccagcggccagtattatctgcatttgtttgccccagagcaggctgatctgaattgggaacaccaaccggtacgcgatgagctcaaaaaggtgtgtgaattttgggccgatctgggggttgatggtctgcgtttggatgtcatcaatctggtgtccaaacagcaggatttccctaatgatctggacggcgatggccgccgtttttataccgatggcccacgcattcatgagtttttgcaggaactgagccgcgatgtgttccagccacgccgcctgatgacggtaggcgagatgtcatccacccgtctcgagcattgtcagcgatatgcggcattaggcggtgatgagttatccatgacctttaatttccatcacctgaaagtggattatcttaacggtgaaaagtggtcattgatgccgccgaatcgggtggagttgaaacacatttttaatcagtggcagcaagggatgcacaaccgcgcatggaacgcactattttggtgtaatcacgatcaaccacgcattgtctcgcgttttggtcatgaaggcgcactacgtttgccagcggcaaagatgctggcgatggtactgcacggtatgcagggcacgccttatatttatcagggggaagaaattggcatgacgaaccccaatttcactgatatcactcaataccgtgatgttgaaagcctgaatatgtttgccgaactgagtgtggcaggccgcgaacccgatgagttattggcgattctggcagctaaatcccgtgataatagccgtacccccatgcaatgggatagcagcgataatgcgggtttcagccaaggcactccctggattgccccttgcagcaattatcatgagattaacgttaatgccgcattggccgacgctgactcggtgttttatgcctatcaatacctgatagccctgcgtaaacaatacgatattttcactttcggtgattatcaggatctttgcccacagcatcctgatttatggtgctatttgcgcagttggcaagggaagcaactgttggtagtcgctaacctgagtgaagagccccagcgatggcaacccgagggcctcacgctggacggtaattggcaattattgatgagcagctacgaccaaagcgccttccaaccgcaagatatgatattacgcggatatgaggggatttattgggtatgtgagtaatttattgggcgcatgggtcattgaatcggtgtgtaggtcatttcattgagtaaacgcgttatttttcgaagggccggtgataggtgactccatcagtgcaaaatgtcctgatggagccgtattcgcaaaatatactgttaactttccaatgtaatcattaacaacaaaataactttcatctcaatgtgcggctgcgattcgtgatggaaaaaagttcgtgatccggatctctttcttttcttgtcggaagcgcctaatatcagattaacattaagctattttctaacaccccctctcctatggcgtgggggtgttgtttttatgttttgctgaaattgaattggagagtgctatgaccaagccaaccatcacgattaacgagctggatgctgagcgtttggatgcgttgctagcgcaaccggcttttgccggttctgtggtcgcaacagcgctcaatgaagaactggatcgggcagaaattttgccacctaatgagattcccgcggatgtggtgaccatgaacagccgcgtgcgttttcttgatctgaatagccaagaagaacatattcggacactggtttatccagcatcattaaaagacagtaatgaacaactttcagtcatggctccactgggcgcagcactgctgggcctgcacgtcaatgatgagatcagttggaaattacctggtggggatgaaacccgcattaccgtactggaactgctgtatcagccagaatcagcgggcgaatatcaccgctaatacgtgatgcagagatgcagagatgcagtgtcaggtaaaaaggtaataaagggtaataaagggtaataaagggtaatagaagataatagagggtaaccgccgcaggccattaccctctatcgctcacttttatatccgccatccttcaagatgcagggcgttggctgcactcattgcctggcccatctatgggcttcgccacggcaagccgcgttccaatctgcgcccttatctatctcaggctcagcggtactttttgtgataggtattgcgggtgtctttaaaatcttgtgccgcttgctttgcttcatccaacttaccttgatccgccaaggccagcgccccatcaatttccccaatcagcacatccatgccatggcgaaaatccttcatttcaggactgtcttcaactttactcttcaattttgtgggaatgcccttttgtgcatccactgcggccactcgcatcgcctgtaaatcttgtttaatcaccgctgtggaatcggccttcaataccttgccgtaatgctcggcaatcgtctccatatcgtcagcaacgctggccgccatgactaaactgctcgtactcagtaacgcggcggtgattaatgccattagtgttttacccatgctcacattcctattgttatcgttaggttagtatttacgacttattttgctcttccttaacataggcaatggcaggtaaaactgacagttaattttagtaatcggtgaaaaaataagggagggggaagtagattaaaagcgtacaccgacaaccttagcgatgagcagacagcaagagttggaaacagtagcagacttactcatttatcaacaatactgcgatattttctctctattctcagcgaccaaaaccacgccccatttggtggtatctggatgcaggctccaaattttttcttcaggaatgcctttaccattatagggaacgcgatcaccacaataagggtaaaactgaccaacgtcagaatctaatataaacaccgccagcttgtccgattcttgagcaatcttctgccacagcgccttaccggcttcatattgtttattatcactcattaaaatcacgccacacttaacgactaattcttcataaagtaatgtagccaaccctttgccacgcgccccctgttcaaccaccattccttccacttgaaaaagagcagaatcttgccaaaagcgctgaacagaaataacgttttcacctaactcttgcttcgcaaccagatcaagagccgcgataatccggtgacgcggtataccattaaaactttccgtattcatacggataatggccgctttagggacatttttatcgaaaatcacaccatatttcatgctagacaattcaaattcatgaatgaccttaaattctctagcaattgtcgctggactataagtacttggcataacaatcatatttgaacttccccgaatcaataccggcataatcattccctttgactataaaacatccatacaaactggggaagactatcatatcaaggaaaagcgcaggcaaactcgcgggtattttctacccgcgagttgtggaacagtaagatgacaggaaggttattattcgcccgcgattttcataacgggcaataaaacggagccgcactgaatattgctgcgagtttcgatatcactgcccacactgacgatattgcgtagcatatctttcagattacccgcgatggttatctcactgaccgggtactgaatctcgccattttcgacccagaaacccgcagcacctcgggaataatccccggtaaccgtactaacgccctggcccatcaattcggtgacgaccaaacctttatccagttgcttcagcatacccgcgaaatcctggccctgaccggcaatgcgccagttatggatgccaccagcgtgcccggtgctttgcagccccaatttacgggcagaataactggtcaacaagtaagtttgcagcaccccgtctttgacgatttcacgttgcagtgtgcgcacgccttcactgtcgaacggtgttgatgccagaccacgcaagagatgtggatgttcttcaatggtcaaccattcaggtaaaatctgttggcctaaatgatcgagcaagaacgtcgatttgcgataaatattaccgccgctgatcgctgacaccagatgaccaaacaggccagtggccacttcagccgcaaacagcacgggtgactgcatggtcggtaatttacgcggagacagacgagatagagtacgacgcgcacactcctcaccgacccattctggcgtagccaaatcctccatccgacggccaatggtataggcgtaatcacgctccatatccccattgtgctcggcaatcacactgctcgagagcgagtgacgactggagcagtagctttgcaacataccgtggctgttaccgaagactttgatgccataatggctgttaaaactccccccttcggtattggtgatccgcttgtcagcctgcaatgccgcctgttctgcgcgggccgccagcaagataccttgctcagcatccagatcgctaggatggaataaatccaaatctggtgcatcaaaggccagcagagatttgtctgcgggtccggcgtaggggtcgggtgacgtataacgggcaatatccaatgccgcctgcacggtgcgggcaacggcatccggatttaaatccgtggtggacgcactgcctttacgctgttggtggtaaacggtaattcccagcgcaccatcactgttgaactccacgttttccacttcaccaaagcgagtgctgacgctgatcccggtggttttgctaacggcgacttcggccgcatcagaacccgcgcgggctaattccaaagcctgtgcaacagcttgttccagcgttttacgctgttctgcaacttgagtgactactttcatcgatctgccataattaatgagataatcgttcagaaaagtgccgtggcggcgtagtaatacgacgacttatacggataaaataaagaacgccatggatctgagtctaacagagatttttgtacaatttcgcacaaagcctggcaacctgctacgattagcctctttttaaggaatttgaccatgaacaaacagcccgaagattggctagatgacgtcccagaaaataaaaacgacgatgacgatgagattatctgggtcagtaaaagtgaaattaaacgtgatgccgaagcgctgaaagaccttggcaccgagctggttgatctgggtaaaaatgcactcgagcgcatcccattggatgaagatctgctggccgccattgaactggcgcagaagatcaaaaaagaaggccgccgccgccagatccagttgattggtaaaatgttgcgcgcccgcgatgtcgagccaatccagaccgcattggataaactgaaaaaccgccacaaccagcaagtctcgctgttccataaactggaaacactgcgtgaccgcctgatcgcggaaggtgatgatgcgatcccaacggtgctagagctgtaccccgatgcagaccgccaacaattacgcagcctggtgcgtaacgcacaaaaagaacaggccgcgaataagccaccaaaatcattccgtcagattttctcgtatttacgtgaactggctgaaaaacaacagtaatcgggcggggccgggtcactcccggctcccgactcaatactgttggcgggcataatctattcacaaagtgatttattcacaaaatgatttattcatcaaactatgtattcatcaaacaatgcattcatcaaacaatgcattcatcaaacaatatgctcatcaacgacattaaaatgtaaacgccctgccaactcttcttcagcctcttctaatagcaatacaatcgcagcaaagcgccgttgatggcggcggctgaaatgaacgaattcaatctctaccggtaacgctatttctccggtgaccacatcccacaacgcatccagattggcaccaaaatcttcgctcagcgcaaaattctgagaaaatgcgcggtaaaatgcaggaagatccggtatatggttaaaatcgaataccacctttaccatcttcttactccatccgaatgaaatgcttatagtgatcttgggtcagataaatcaggccatcattggagtacagcaagcgatcactaccacgacgcccacagcggtaattcacatcagcttctcgccaatgacggcctttggcgtcaggcaactgacgctcacggttggagaaacgatcaccgccaatggctttgcccggtaacacgtcacagaggttccccttttgggcatcccagccttgctcacgggcctgtttcttcgtcaggtaaaaatccggtagccgatggtgcgtttgtaagtatttcaccactttctgatgttgcgttaacgactcagtagcggcagaggccgaaagcgccgggcgctcaagctctgccgaggaaccaatatcacgcaccgttacgccatcaatcccttgccatgcacctgctatcaatagcagcacagcacccagtatggccatcagtcgtttattcatggatccccttaatccccaggctccctaccacggcggtactactcattgttgcccttaatatcgttcctacaattaatatcattcctacaattaatgccattaggaccattcatatcattatgactattcatatcacatatcattattacaacttatacttaacgctaacccattaactcgaccgacaaggttgtctacaagttacccaaatgcagggttttcacttccataaattcatccaaccccagcaccgaaccttcacgacctaggccagactctttaacaccaccgaaaggggccaactcggtcgaaaccgagcattcattgacgccaatcataccgctttccaacgcctctgaaacgcggaacacccgttgcaagttctgcgtatagaaataggccgccagcccaaatggcgtattattggcccgttgaatcacttcggcttcagtgctgaaacggaagcaggcggccagcgggccaaatgtctcttccgaggccactttcatctgctcattggcatctgcaatcaccgttggctggaagaaattaccgcccagcgcatggcgatgcccccccgctaaaagacgcccccccttctcaagcgcgtcttttacgtgctcttctactttctccagaccggccagattaatcaacggccccatgttgacgtctttatccatcccgttgccgaccttcagttttttcacctcggcagccaagcggttaacaaactcgtcgtagatagcatcctgaatatagaagcgattgacgcacacacacacctgcccggcattacggaatttacacgccatagcaccggcgaccgccgcctctaaatcggcatcatcaaaaacgatgtaaggcgcgttaccgcccagctccatcgaaattctcttcatggttgcagcagcattgcgcatcagcgttttaccgacattggttgagccggtaaaggagattttacgcacgtctgaactggccataatcgcgtcgctgatagcatgagtatcccccacgacaccattgagtaccccagctggcacgccagcctgttctgccagtgccagtaaggcgaaggcagataatggcgtgttattggcaggtttaatcagcccggtacaaccggcggccagtgctggccccagtttgcgggtgagcatcgcgagcgggaaattccacggtgtgatagcggctaccacaccaatcggttcgcgggtcgccaggatacgtgcgccctctttggctgacgggataatttcaccgttagcccgcttggcctgctcactaaaccattggataaaactggcggcataagccacttccaccaaggcttcttttaagggtttaccttgctcggagaccatcagctctgccaatgattgctgatgttccattatcagcaaataccaacgctgtaaaatctctgctcgctgtttagcgggcgtttttcgccaggcagggaaagcctcgctggcagctttaatcgccgcttcggtttcttgtttaccggatttagccactctggcgaccagctcgccggttgccgggttgcagacgtcaaattgctcctgtgcctgagaccattttccaccgacaaaatagccaatgtggtatataccgtcgtgctgtcgttgatgttgtaaaggattttgtgcgggcatagtgtcaacctcctgaggagatgatgccccccatcaaagggaggcgaagaaggaaggtaccgaggttgatgacaacgtgcctgcagcgggagaagagagaaataacaaagacgccgtgagcgcctttatgagggctcgaaccgcgccttccctgcctatcctcaccatttaagatcgaattatcggggtttgtcagcagtctggtaccaaacttattatagcccttgatgaggtgatgagaacaccttatgtccgtaggttatcggttaaatcagcgcactctgatatttacgcaacatctcagtcaaccgcttaaccgggcggataaccgcatcagcagcctgataatccaccaatttctgttgatattgatccagttcctgcaataaccgggcaaaataataacgccgtttctggtcattgttgacagtaatcactcgctctgcggtagagcggatctgtttatgaaaagcgctcaactccgcattcaccgggatttcagtcctgtttaaccgctggtgagcaataatcagcgttaatgccagacgatatttatcaatatcggccgggaacatcatcaataactggttcagttgctgatacagcgcgggtagatgattttcgccgcgcttggttttattggtggttagggccgagaccgcactgtaaacaaaacggttgagtaaggttctgcccgttctgtccttcgcgttgtcacggatcaacagcaggacaattaaagagacaaagcagcctacaatttgacctaatgcgctatcgagaaactggcggacattaaatatcattggattacttagcacgataatatttatggtgctagccagcgttcccagtgaacccaagcgccgtttttgtacttcgatgccgataataaatgccagcacacccaagctgatacaaagcaacagcatactttgctgggtcgacgggataataaacataaagtaaagcgccccgatgggcagtgcgataatcacgccgaccagaaaatcgagcgccatcctccgtggattcggtgttcgcatcgccagcgaagtgaccacggcaatcatcaccatacaccccgcgccggatgtccagccggtccacagccagaacaggccaccaatcgccgtggcaataccggtacgcaagccattgatcatcgcatgatggccttcggcagaaatgggcttaaccggcgcatcacccgccaaaatatcctcttcgacctgattgatgctgctgttggtctggatccctttcgacagtaataaatagcgagtcgctgccccaacccaactgctgatggtgtgcgggatcgcctcactgtggctggcagcaataaactgacgcagttttttcatctgctggtggatctctgcaggagtttgagcgggttcgctcagcatagttttcagttcagcactgatcacctctgggtgattgctcatcaccagataggtttcacacgcctgcgtgatcagcgccaaagactcggtatgtaacacctgcaaacggcgattacaccgctgccaacgggaagactccatcatcagatagctgcgcatcccattgagtgacgtggtatttttaaccaattcattccaagcgcgatcaatctcacttttttctgctggctgaatgcagagttgtaagagccggtactgatccactaacaccttgtcgaccaatcgatcaatatcctgtttgatcgagcggggtgaaaacagcagatctgccatcaccgcacagacgatcccgaggacaatttcgctacagcgctcaaccgcaaattgcggcgtcagtagtggcgtttcaccggtggtgacaatgatgattaacgcggtataaccggccaaaccgaacgcatacgaattttctacccgtaccagcgatgaaatccacgtacagatcccagcccataggcaacacagcatcaacgttaatactggcgctctgatggtcagcacaataatgaccagccccccaatacagccgataaaggtgccgataatccgtaaccaacctcggtggcgaatcgcaccagagaaaggttcgccacctgcagcgaaggcaggcccggcggaaacaatagcggcagtaagcactgaccaacgcggtgtttccaattgcagatgaaagccaagaaataatgccgccacaatggcaaaactcagcttgaacgcaaaccgcaggcgaataaagcttgggtgggtcatattagccaaactcacgtagacgatgcatcaacttggtcatgggcgatgcctgatgaggatcacgatcattcggcccggtgatcaccaccgtggccgtggtgcccgccggatacaaatattgctggtcttcgctatccagatgaatcttcaccggtacccgttgcgccaagcgtacccattcaagattattatcaatggtcgccagccctttgctgtcggcactgctactgctattggtaacaccggctgaaatgctatcgaccgtaccatgcaggatgcggttactgcccagcggggtaatttccgctcggtagcccggtttaaccccttcgagcttcgtctcctccagataggctaaaatgtagaaagtatcttttttcaccaatgcgactgccgtggccccacggttaataaactcgccagcatgtacattcaggttggtcacccacccttctgctggtgcacgtaccgtggtcctttccagatcaaggcgggctaaatcccgcacggcaatggcttttgccaactgatgctggacggtttgcaacacattgcttgcctggtcaatctcttcttgtgacagcgcctgaatacccaggcggtgacgcctactggactcccgttgcttctccgcagccagggtctggtaataggccacatcggcctcggcttcagccaacgcctgctgataacggggctgatcaatgacaaacagaatctggcctttctgcaccagttggttgtcttttaccggtacttcggtcagtaagccgctgacatccggtgcgatagcgaccacgtctgcggtaaatttagcatcacgggtccacggcgattcagtatagaaggcccacacgttgaaaatcgcgataacagccagtacgaccaccaagacggtgatgccaacgcggattatttttaatgaaaatgtactcacggtgacctcaggaaaaaagacgggatgttaaataaaacaggcaacaatacagcgccgtattaaaaagagccgggtgccaaacaaactcgtaaataccggttggttgcaggatgcggcgcacaacaaaaaacaaagccaatgaaattagcagctcaagaaatatcggtggaaaagagaggccaaaaatcaccatcaccggaagcaaactcattctttaaatcctttatgtttaaggttcgggtcatttagcctgcgttaatgcccctacccacccaacttacctgctgggtactcaaagcaaaagccataaggcagtcttatgggttaaactgaagctattgaattgaataaattatgataacgcttcggcgtggtgccgtattcgcaccgataagcaaaacgtgaggctattctcccgacaacagtatattagcctgcttattatcaagttatctacgatgtgtgatctaaatcacttttaagccagagttaataatacagatggaataagtaatggaaagattaaaacagatgtctgtttttgcgaaggtggtggagtgcggctcttttactgccgcagcacgacgactggagaacagtgtctcttccatcagccaaacggtatcaaaactggaaaatgagcttaacgttaagctactaaatcgtagtactcgacgtattggcttaacggaagcgggccggatttattaccaaggctgccggcgtatgttgcaggaggtgcagcaagttcacgaacaattgtatgcttttaataataccccaaccggcacattacgcattggttgctcctccaccatggcacaaaatgtgctggccaccatgacagccgatatgctcaaagcctatcccggtttatcagtgaatctggttgccggtattcctgcaccggatctgatagctgatggcctggatgtggtgatccgcgtcggtgccttgcaaaactcagggctgttttcgcgccgcctcggtgctatgcctatggtggtgtgtgcagcaaaaagttatttgtcacaatatggcacgccagcaaaacccagtgacatggccaatttttcctggttggagtataacgtccgcccagatagcaattttgagctgatcgcaccagaaggtatcaccacccaaatatcaccgcagggtcgttttgtcaccaatgactcacaaaccatgatccgttggttaaaggccggggcgggtatcgcctatgctcccttaatgtgggtgattgaagaaattaaacgtggcgaggttgagattctatttaaacactatcactccgacccgcgcccggtatatgcgctttatactgaaaaagataaaatgccactgaaagttcaggtctgcattgattatttgaccgagtatttcaaacgggtcgctgaagtttatcaggattatcgctaacggtatgttatatcaaataacaaattaacctgatgattaaaaatcatcttgaaataagaaataactgttaaataagatatttattatgctaatttacgtaagaaataccattacctaacatacagtatttttgctaacccgcctccttagttgactaaaataacactaattattctaatatatgaaatagacttaacttatattatagatatattgtacatctacatatcgcgacaactaatagtaaataagtggtgcatatgtttatatcaaaaaatttactcgtattctttactacggttcaagagggatcgttgactaatgcagctgtgaaactattcacaacaccgccccccatgagtagaagcttaaaaatactggaagaggaactgggttttaaactgttcacacgtacaacatcgggattaaaactgacattggaaggcgctgctttttatcaagaaatttacccaacctacgtgcgattaactgaaataacaaagaattacaaaaagaataaaaatggtattataaatatcgccacctatcagttgaattcagatcatgctggcgtgatatgtgattactttataaaaaaaggtaattttaacattgagttaagagagaatattggtgatatcagtcaaatggatatcgtcatcagtaccaaagagataaaaggctatgatttcgatactgagctaaccgccagttgtgaaataaaattactgtatgcatcacatttgaatgacttgcctgatagagttgaatatttaaagaaactgccctttatacaaagtagtattttttgttcttcctgctgctttaagcgattttcacacaacctaatacaacaaggctactcagggaatgcactgcgtattgatgatgccagagttcgccatgaaataattaaaaaaggggcaggaatctcgctatcaacaaattatttttttgataaaaaaaagataagtcactctaccgaaataagttttatatcagatatcaaccttgacattacctattacatttactttaaaagctcagtaattaacaaagaatttttcatccaatacataacgaataattcactcctgcagtggcagaaggcagagaaaaaacactaagtcagatgcaacacgtagttaaatacaatttgtttaactaaaatttagttaaacagaagataacaataaaaacaccagacagaaacgatagcgcgtcattttatccctaaagtagttggagttgcagaaaaattaattccgaggaatttacgcaggcaagttatttaggtaagcacatcgttaacacctgctgtttcacatcccaagctaatgtccttaaatatagaggtaaattatgcaagataatatcgaccatactgcatccgttatagcggatactgataatacgattcatcagcaagccaaagcagaagagcgccaccgccaggccgtcaggcgggcaacacagctacgcaacgatccggtactcagtggcatcaataaactggccttttctgttgcaccaaaaatattgcagcctgaagccagaacagatctttcactggccgaaggaataccagaacgagcaaatgagtatgccgatccggcatctatccaatccttgttctctccgggccgctatttatgcgaattgtatcatgtagcaaaagagttacatgaagatggaaacaaactgcatatcgataaacgccgccctgatttacaagagctggtgcttagtaacagtaatatgaatcaagaagtctcttcgctggagatcttactcaatgtactgcaaacgaagacgcctctggatgagctgactaaagataccgaagcacacgcaaatgacagttctttcaccctgccttatgacgataacctgacagtcattaatgcaatactggaagataaagctatcagtctgcgagaaattgcagtgctactgacggaggagagtgattttagccctacacccgcattagtacaggaacaactgggattgaatccggccagttatgcattaattgatataaaatccccattggatgagagttacgccaaacgcctggcacatgccacgcaactcagtgttgaacaactgcaatggcttaataaaaatgccattgaaaatagcagcaataaaaatgatccagccaaactcgaaatactcgcagtcatctccgaatatcgccgtttacatcagcgttacggcctgtctgtcgatccgtttatcgccattattaatgccgttaacaccacccataccaacgaaaataaaaccagtttcttccagcagattttctctacccttgatgtagatgcaggatttaacttccttgatcagggttcgtgggaagtgattatccgcaaggcattgggcattactgccgaagaactgttacgtattgcgaaatattgctttggtaagagttcaattagcaacgtaaagatgaatagtaaaaaattcagccaattataccgtatggcaatgatcccccgcacacttggtgtgagtttctcgcaagctgaatatctatggcagttatatagccattcagatgaaaatattatggaaaaaatagcccagggtaatgctctgaccattattgatgccattattgtgctagaaaatacccttcaatggatgagtgagcaaaaactggatatcaccaccctacaagccatgctcaccaagcaatacagcaccacagcgacccctgaattatttaatttcttatccaatatttatcaaaccttaggtaagcaagtttattccgaatcgctcaaacctaatctgtatcgcagcttggcaaacggcttccacctaaaagctaatgtagtcgcagggctggtcaattggttagcaaaaaatgactctgaatttaccttagaaagattttggcaaaatatttccatgacctttgctgaagagccttcattgcaccaactggaagtccatcaacccttgcttattcaatgccaaaaactgagccaatacgtattaattgcgcaatgggcagagttgtctgaacaagagatagcattaatcttattacccaatggcattgataatagaggcagtgccccttctccaagtatcacgctgttaaagttattatctgaatttaagttatgccaacaagaggctaaggtgtcacaaagcgaattatttgacattatgcaacagctgattactaatacaaatgaaaaacaagaaaaattaagaaattcagcagataaagtaataaggtcaatagcaaaaagcattggttctataaataacagcatggatgatattgattcaaccatatcgattagaaatggtagcgcaacactgttccccccagaacaccccatgtataaagcacttaaacttgaagtatcaaaccttgaaaaatcaaaaattcagttagaaggtaaaaagaaagaagaggagataaaactagaacaggccaaagacaatatacagtcactaattaataattgggacagtgaaataatcatacgtttggcagacgcataccattgggatataaacattgctaatagtatgtttatacttatttttggcgaaaagataaacttcactttccattatgagaatagaaatgattatcattatgaagaacactatggttatcgttttgaacaaaaaccaatgtatagttttgataaaaaattgactaatgggtttggatcaatcttattattgaaaaatcacatttatatcgctgaaaaattaaaaatccatcctggaaccataattaaaataaaaaactatatttttgatgataagagtaacgagttagagaatatcgccaacaagctaagagttaatctttaaaaaaacgttattacatccaaatttaataggaataataatcatgcctactagcactgtattaaataaaattaacgaatcgcgccgcgacgcattggttaactactatcttgctaaaaatgtcagcggtgacgagaaaattaaaactgcagaacaactgtatcaatatttattgttagacactaaaattggccatgaagtaaaaacctcacctattgccgaagcgatcagtagcctacaaatttatattaatcgctgtgttgatggagaagaagatgatctccatgaaaaaaacatcagtacacatttcagtagcgataattttctgcatggctggaacagttataataaacgctatgcacgctgggcgggtaaagagaagctaatgtattatgcggcagactatattgaccctacattgcgctataataaaactgagctttttaatacttttgagcagagtatcaacaacagcaaactgactgaacaatctgtaaagtccgcattacaaagctatttaatcagctatgaaaaattgactcagttagacaccatacaacaactgtatgttgaagagatagaaaccactttctttcttggtagaacccgtgaatcaccttgccaatattattggcgaagtggcaaaaaaacggctgataacggaaaaaatctgatctggtctgaatggaaaaaagtcgaatgcaatattaatggtacagaagagaaattatttatagatattagctggtatagacaccgtctatacatcaactggctcgataacacacattttaaaacagacaaaagtgaagataaattacaatatcattttaatcgagtatataaaaaccatgaaaatacatgggttgaatccattagtaatatgaaaattggcttaccattaaacgacgatagcgataaaataccgatcgtttatcttcatgatggtgaattatacactaatgaagacaataaaggtttctttttattaagtgatacgattattgataagctaatatttagtggagtgtatcttgagggtaaattaaaggttacatttaatgatgaagagctaacatttgaagtgctagaaaaatttatatcaccatattcgaccagtatggaattcaccttaaatatacataccactgaaaaagttaatgttaaaaataaaaaagattctaaggtatcaactaaattgacagataacttcactatcactaccgaggctggtgggatgctcgaaacgagcacacttttccatagagtaaaattcaacagtggtattattataaaaacggaaaatgacatttctttattaccacctgatagcctaccactggtagagaagcttcaaacatcagttgatgaactgctcagttatagcacccaaaaagataaaataggattagacgcattcaatggttcctacggtatttatttatgggagttgttcttccacattccattgttaacctcgatacgtttcttaaatgaacagcgttttgatctggcacagcactggttaaaatatctgtttaatagtgccggttatcgtgatgggaatggcaacttgctaaaggaaggcgataatatcctttattggaatagcctgccactgcaacaagataccgcttgggataacaatacgctaatacaggcaaccgacgacccggatgttattgccatgcaagatccgatgcaatataagctggcgatctttatgcgtaccttagacttgattattagccaaggcgatcaagcttatcgtcaattagaacgggatacgctggccgaagctaaaatacactatattcaggccagtcaattattagggccacgcccaaaccttaatcgtggtcatcagtgggaagacatcaaattagcagaagaaagtcgccaattggagaatagtcatttcctgccaccctataatgaactgttattatcctattgggataaactggaaattcgcttatataacctgcgccataacctgaacttggatggtcaaccattacatttacccctctttgctacaccggttgatcctaaagcattgcagcgtcaatacggggccggtaatggcatcaatagtggtgagcaaatggcaacagcgcaaacctcgctgtatcgctttccactgttaattgaacgagcaaaaagtgccgtcagttcggtgattcagttcggcaacagcctgcaaagcgtgctggagaggcaggataacgaagccatgacgttgttgttccaacaacagcaacagaaagttttgcagcacactaaagatattcaaaacaacaatatccaagtcttgcaagccagcctagaagcgacagattcactcaaaagtgctgcagaacaacggcgtaagcattataaggagctgctggataacggtatttccagcgatgagcaattagcgattaatattcgtattgcctctgcggccctcaatggtgagtctctcgtccccttggggcttagtgctgttttggatactgcgcccaatgtttttggcttggctgacgggggttctcgctggggggcgatatcacaagcggttggctggggaatgcagagtatggctatggccctagaaaccaccgcgggtgtccgtgatgcaaaagccaattatagccgtcgcgcacaagaatggaccttgcaaaaagatcaggcggataaagacattgaacagttagcgcaccaatataccagcgtgcaggaacagctcaatatggcgcaaaaacagctggatttagctgagttagagcgaggccatgccgacgcactgtatcagatgcaaagcagccgttttaccggcaaagagttatacaactggatggcaggtcgcctttcgggcctctatttccaactgtttgatgccactcaacccctgtgtttaatggcaaaggcggcactggaaaaagaggtcgataaagcgaaaaccgatggcttatttatccgctccggttggaacgatctctatcaaggactactggcgggtgaagacctgcaactcaatctgcaaaaattggaaaatgtgtggctgatggaagaacagcgggcgctggaagtagagcgtaccgtttcattggcacaacattatcaacagctaagcgaccataagttcaatctggcagaaatcgttacgggctatatggcgcaagataaagaccaaaaaaccggtaatgaacaagactttgttgaattaaaaaatagcaccttaattacctccctcagcatcaagggcctgaacctggttgaggactatccggaaaccatgcatttgggtgatatccgccgcatcaagcagataagcgtgagtttaccggcgctgttagggccgtatcaggatgttcaagccactctcgattatgcgggtgaaaatacccatctggcaaaagggtgtaccgcgctggcaatctcccgcggaatgaacgatagcggccagttcctactggactttaacgacggtaaatatctgccgtttgaaggaattgatatcagcgacaagggcacattggtgctgcgcttccctaatgcaactagcaaacaaaaactgctgctgcaaagcctgagcgacatcattttgcatattcgctacaccatccgttcctgataacgccgttacctcagtcaacaggccccacagagggcctgataggagagccctttatggaaaacagtaaacagcaagtggccgttgctcccttgtcgctccctaaagggggcggtgcgattaccggtatgggcgatagtttaggtcctatcggccccagtggcatggcaacactgacgctgcccctgccgatctccgcaggccgcggttacgccccctcgctcacgctaagttacagtagcggcagtggtaacggtccgtttggccttggctggcaactcggcaccatggcgattcgccgccgaaccaacgcccaagtgccacgttacgatgagtatgatgaatttctggctcccaatggggaagtcatggtggttgccgcggatccgcagggcaatatcgaacgcactgaacagtcactaaatggggaacaattcagcgtaattcgttacttaccacgtattgaaggcaattttcatcgcattgagtattggcgaccccggacaaataacagccaggcaccgttttggttagtccacagttcagatggccaaaaacacggtttgggatattccgcctcagcccgaattgccgatccactgcaccctgagcatattgctgaatggctactggaagagtcggtgtctctgagcggtgagcatatctgctaccagtatcaggcagaagatgaacaggatattgacgaatctgagaaacaaaatcatccggcagccagtgcgcaacgctatctaagcaccgtggtttatggcaatagagaagtggcgcatgaactctattgtctgactcagcgacctgcgccgacaagctggttatttagcctgatcttcgatcacggcgaatacagtaatattgcggagcaggtgccggtaatcataaaaggaaaatcttggaatttccgtcaggacgccttctcacgctttagttgcggctttgaagtgcgtacccgccgcctgtgtcagcaagtgttgatgtaccataatttgtcagcgcttaaaggtaatgaacccgatgctcaagccacgctggttagccgtctgcgtttacactatcagcacgatgcttatgccacccaactggtgggttgtcagcagttagcccatgaacccgatggcaccaaacgtagcctgccaccgctagaatttgattatcaggatttttcaacgcgtgacgcccttggttggcaaccacttactgattgggctgaatttaactatcagtaccaaatggtggatctcaacggtgaagggatgccggggatgttgtatcaggacagcggtcactggatttatcgcccaccggttcgccaaccaggcaccgccgacggcatcacttttggcgcggcccaacagttaccgagcctacccgcgatgcgcgaaaatgccatgttgatggatatcaatggtgacggcaagctggattgggtgatcagtcaaccgggcttagcgggctactttagccgtgatcctgaccttagccgtgatcctgatcttagctggacacaattcatcccgttatctaccttgccagcggagtatttccatccacaagcgcaactggtcgatttagccggcagcgggttatctgatctggcgttaatcgggccaaaaagtgtccgcgtgtataccaatctgggtgacagttttgctgccgcaacccaagtggtacaagatgatgacatcacactaccactgcccggtgctcacttcactgaactggtggcgttcagcgatgtgatgggttcgggccaacaacatctggtgcgaatacgccacaatagcgtcacctgctggcccaatctcggccatggccgttttggtcaccctatctctttaccggggtttaaccagcacattgagcaatttaatccgctagcgatctatctggcggatattgatggctccggtaccattgaccttatttatgccactgccagccaactgctgatttaccgcaaccagagtggtaaccgctttgccgaaccagtggctatcgcattgccaacaggcattcgctttgataatagctgccaactgtcactggcagatattcaggggctgggcgtggccagcatcatgttgagtgtgccgcaccccaccacacaacattggcgctatgattttgtcgccagtaaaccctatttactgtgcaccaccaacaataatatgggcgcagagagtcagttgttttaccgcagttcagcccaattctggctggatgaaaaagcgcaggcggccaaacagggccgatcactggcctgccagttaccctttccgatccatctattagcgcaaaccacacaacttgatgagatcaccggaaacagcctgagtcaaaccgcccgctacttccatggtttttatgatggcgtacaacgtgaattctgtggttttggccgtgtcgatacgctggataccgatacctccgcacaaggcagcgccgctgaacgcactgcgccgaccaaaagtagtcgctggttccataccggccgggcagacaatgagacactatggcaaagtgagtactggcagggcgatgaccaagactacccattacttcccacccgtctgacaaaatttatcaacgatacccaaggtgacgacttactcagtgaactcgatgataatcaaacgttttggttacaccgggcactgaaaggttcattgctacgcagcgaactctatggtctggacgacagcaaactggcgacacaaccgtatagcgtcaacagctctcgctatcaggtgcggcaaattcaatcctctgctgatggaatctcatccccggtagccttaccgatggtgctggaacaactcagttatcactacgaacgtatcgcgcaagatccgcaatgcagccaacagatagtgctgcattgcaatgaatttggtcacccactacacagtgtgacaatcaattatccacgccgcgataaagcccgtattccctcgtattcctggctggctaaagaacattgggacagcaattttgacgagcaacagcaacagttgcgcatcactgaaagccagcaatcttatcaccatgagatcagtgataaattctatgtgctgggcctgcctgccgggcagcgcagtgatgtactgacctatcccgacaatttcgtgcctaccgcggggattcattgggaagaattacagcagccagagggcctgctcggtactaaagcagagcgaacctttgccgggcagcagcaagttttctacacctcggacaccattccgggcctggttgcctatagtcaacaggcagaatttgacgatcaaaccttggccgcgttggatgaattattaccagcgaatgagcgtaaacagcagcttatcaaggccggttatcaaacagcaccccgtctctttgctcgccccggagaaacggatatttgggtcgcccaaagtgggtttactgattatggcgatgcctcccgcttctatcgccccatcagtcaacgtagctcactcttggtaggaaaaacggccttagggtgggataaaaatagctgtgctatcacccaaatgatattggctgatggcagtaccacccaggctgaatatgattatcgttttattaccccttatcacctcacggatatcaacgataactcccgtcatattgaactggatgcgctggggcgcatcacctccagccgtttttggggcactgagcttgacccacaaaccaataaagtcattgagaccggttttccttcaatcgcggaacagccctttaccccccccaattcagttgatgacgcgatcagcctggagaatacccgcattcccgtcgcgcagttctctgtctatcagcctcagagttggatgatttcattacagcgtgatgagattgaaatatggattagagtcaataagatcactccagaatatctattccagaatcatattctgatcgataaccattatctttgcccccttgcgctacaccgctgggtaagacaaaacaacctgctcatcactgaagatgttggcctggcattagaaatgcccatgcgccaaccccctcatatattaaccgtcgtcgtggataactacttttctgctgctgagccacaacaacatcaacaaactctcgctttcagtgacggctttggccgcgtgttgcaaagcgcgcaacgggtggaggcaggaaccgcttatttccacacaggagagggcggtctggagatggatcaacaaggtcatctcacgcaagacgagagcgataaacgctgggcagtttctggccgtaccgagtacgacaataaaggtctgcccatccgccgctatcagccttatttccttgatggctggcgttatatcgcggatgacagcgcccgtaaagaagcttgggccaacacccatatttacgacccactcgggcgagaaataaaagtgatcaccgcgaaaggttacctgcgacgaactcactatttcccgtggtttgttatcagcgaggatgaaaatgacacggcgtcagaaatcacgccgaatccctaatattagccgcagagcctaaccggccccttcccggtcaggctctataccctgtcatctcaaggcgcaggacgatgatctgcctctgcacctacacctgcaacataaaagatgacgggtatacacagaggatattgacaaaatgcacgtccaggtacccatcgatgatttttttataacctgggtgatcattggcacattttcggcctggggaggattagtgcgctatatcgtcgatcaaaacaacgaatatgaagagtggagctgggtaggtgttctctgccaagtcattgtttctgcttttacgggtttgataggcagcctgttcaccctggaaacagggagtagccgctatatcacgtttgcaatcgcaggcttattcggcgcgatgggtaacaccgcactgaaacatctctggcagcgctttttcagccacagtaaataacaggtggaccctatgattaatgacaaacccacgtttcgcctaagccaaataagtgaacataacttacaccacgttcatcccgacttagtcctgatagtacgccgcgcactcaccttatcccatattgattttagggtaatcgaagggatacgcacccctgaacgccaacggcaaatggtgctcaatggccacagtaaaactatgaacagccgccatctcactggccatgcggttgatctggcgccaatggtgaataacagaatcccttgggatgactggcatgcttttgcacatgtcgccaaggcgatgaagcaagccgccaaggcgatggagctgccattgcaatgggggggcgattggaaaaattttcgtgatgggccgcattttgagctgcccagagaatgctacccatgatcagcttgagcaccttattcggtctgggcaaatccatgatgctgctggccggtgttgtcgccattgtttggggtgtgcaagccagccgaacgctgggtaggctcaatcaggaaaatgtgcaattaaccacgcaattggcgcgcattgggcaaatcaatcagcaactcacacagcatattcaggccaccacggttcagctcaagcaagctcaggagcaagagcgtctggaaggagaaaaaagcagtgaattacaaaaacgcttgcgactggcgccaaaaggtaaccgctgtgctgaggagcctgtgcctgctgctgttatccgcatgcagcagcagtccttcagtgacggtaaatgagtgtttgccttttcctgaggttttgctcccaccgtgtcagatgccgacgtttgatgtccagacctggggagattatccacattatgtggagcgcacgcgcctggcgatggtgcgctgtaatgctaaccgggagtcagcgttacgctttttgcagcgatagatttcacaacgatagacttagcaacgacagacttaacaacgacaggctccacaacgttagatttcacaacagtaaaataactcgttaaggaataattttatgcctaatacgtcacccactgatctgtgcgccaacacccccagtatcaccatccacgataaccgggggttcgctatcatcgcactagcctataatcgtaccgatacccaccaaacgcccgaacaactcattaactgcaatcgctataacgccttcggtcagctaatcgccagccgcgatccgcgccttgaggtggataatttccgctatcaatacagcctcagcggtgttccactgcgtaccgacagcgtcgatagcggcagtacgctgcaactggcagatagtgctggccgcacggtgctctcgcaggatgcacaccacacccaccgctgggtagagtatgagaccggtgaacacagtttaggccgcccgctaagttacagcgagcaagccaacggcggcctgaaaacggttaccgaccgctttttctatggcgaaaatagcgagcaggataaaagcggcaatctgaacggccagtgtgtacgccattacgacagcgccggtttacgggcactgattagccagtcgattattggcgtgccattgcagcaacagcgccgtctgttgacggatatcaaaggcccggttgactggtttggcgaaaaggagaactggggcgttcgcctgaatgaacagccgtttgttagccatagcaccaccgatgctctcggccagttaatcacgcaaaccgatgccaaaggccatatccagcgcatggcctataaccgcgccggacaacttatcggttcgtggctaacagtaaaaaatggtgctgaacaggtgatcctccgttcactcacctattcggccgccgggcaaaaactgcgtgaagagagcggcaacggggtaattaccgaataccgttatgaaccccagactcagcgtttaatcggcattaaaaccacccgcccggcgaagaaagaccgcccccccctgttacaagacctgcgttacgattatgacccggtcgggaatattctcgccatccataatgacgccgaagccacccgcttctaccgtaatcagaaaatcgtaccggaaaccacttaccgctacgatgcactgtatcagcttatcgaggccactggccgtgaagcggataccaacggcatacaaaatagccagttacccgcgctggcgttactgaacgacagcaaccagtttgtcaactacacccgccgctaccactatgaccgcgccggtaatctgctgaagatacagcataccggtgccagccaatacagtacccatatcacggtgtccgattcatccaatcacggcattcagcaacaagatggcatcaccgcccgtgatattcgctcccagtttgatgcggcgggtaatcagcaacaactgcaacccggtcagcccctgcgctggaacagccgcaatcagttacagcaggtggaacccgtgccccgcaacgatggcatcagtgacagcgaaagttatctctatgatggtggcggtagccgggtggtcaaaaccagtctccataaaacccataacgcaatccaaacccgttcagtcatttatttagcgggactggaactgcgtagccaatataatggcaataatctgacagaagattttcaggtgataacagtgggtgccgcgggccgtgctcaggtacgggtattacactgggagagcggccaacccgttgatatcgtcaatgaccaactgcgttacagtttcgataatcacattggctcggcgttaatcgaattagacagcgacggagatattatcagccaggaagaatattacccatttggcggcaccgcggttttggcctcccgtaataccgtggaagccaaatataaaaccgttcgttattccggtaaagagcgcgatgccaccgggctgtattattatggttaccgttattaccaaccgtggctgggccgatggttaagcgctgaccccgcaggcactatagacggactgaatttataccgaatggtgaggaataatccaatcagattgcgcgataacaatgggctgttaaccgaagagcaaattgatatgtacgttaatttgcttagtaatattggattaaaaaatgatgatgaattaaagagtgaactattaagatatggtttgagcgaagaagagcaagaccagatatatttaaatatgccaatgtttacgcagcctggatcatcaagctcatcagccacgtccctttctgagaatagttccagttctgggagcacgcaaagtgctgattcaggttatctcagtccagtaagaaactatcatttttttgaagatattaatttagtgacaatgcaccgcccctatccaaaagaaaaagtctctagtgaagaaataatatctgcagcagcagagttaaaagaagttagtcctatagatactctaattagtttggatttgaccagtgaaaacctccaatcgtatcaatcagcgcttgccgatgaaggaattgactatatcactaaagaaaaatatgaaataaaggatttttttgaagaaggagatttatcgactgaacaaatagatctgacagtaaataaaatattaacattacaagaaagtgctattgttggggttcattgtggagcaggtaatggaagaagtgggattattgcatcagcattagccattaataaactgtatgcaacaaatgaagtaagtagttttgacgcaactcattcattaggagggacaatgcatttaaaaacagacacataccaagttgatattgtaacagccagtgcggttgggattatcagaaaaataaatcctaaagcagtggaacgtgatgaggatgtttccgtcctatatgactattcttatttgttatatacaagacaacactctacatcattataatttattaattcgaggcaccttccctacttgaatagggaaggtgtctatacccgtaatactgatttttaaaatcgctgatactgacagcagcattggcgaaaataggttgaactaatataccgatactttgttggcacaaaatttaatatcaaatttagtgccaacaaagtctactacccatattgtattttcgagcgcccctacgctgtgccgcccacggttaaattatccaacttcaacgtgggttggccgacacccaccggcaagctttggccctctttgccacaaacaccaacgcctttatccagcgccagatcgttgccgaccatggaaatctgctgcatcgcttcaatgccagagccaatcagggtggcccctttcaccgcatgagtgattttgcctttttcgattaagtacgcttcggacgttgagaagacaaacttgccagaggtgatatccacctgaccgccaccaaaattcggcgcatacaggccgtactccacgctggcgataatatcttccggtgtcgattgtcctgccagcatataggtgttggtcatgcgtggcatcggcaggtgcgcataggattcacgacggccattaccggttggggctacccccatcagacgcgcgttcagtttatcctgcatataccctttcagaatgccattttctatcaacacgttatattgacccggcaccccttcatcgtcgatagccagtgagccacggcggccttgcatggtgccatcgtccaccaccgtacagagttctgaagccaccaatttgcccatttgcccactgaataccgaactgcctcgacggttgaaatcaccttccaacccgtgaccaaccgcttcatgtaacagcacgcccggccaacctgcgcctaacactaccggcatcgcacccgctggagcggcaatagccgaaagattaaccagcgccattctgaccgcttcattagcaaaattatctgcccgcacttcgccatcaacggtttcaaggaaatagtcataaccgaaacggccaccgccaccgcaagcaccgcgttcacgtttgccgttatcttccaccagtacactgaccgaaagacggaccaacggacgcacatcggcagccaaggtgccgtcagtcgcagccaccagaatctgttcatacacgccggtcagactggcgctaacttcctgcacccgtttatcggcggcgcgagcgactttatcgacccgatgtaacaaggcaattttatcttcccgcgataggctttgtagtggatcaagcaacgggtacaaggcttgataggcaatctcacccaaggtatggactttgccgttgccagtgtcacgaacaatactgcgggccgcgtgggcactttgctgcaacgcattcaacgtgatttgatcagcgtaggcaaaaccggttttttcaccacttaccgcacgtacgcccacaccctgatcaatattgtaggagccgtctttgatgatgctgtcttccaacacccaggcctcgtgatagctggactggaaatacaggtcagcataatcgaggcggcgttcagttagctgccccaacactgagaacaagtcctgatggttcaacttgttagcagtgagtaactgctcactgacaaatgagaggctcatagtttttactcttaattagatggtggtttattcaataatggtttattcaatgtcggctccagcgtcgcctgaaagcgattgtgctgcatgaccggcatttgattgcgaatcgtcttcaaacctgcggtttcaattcttacttttagggccgccaccgcatctgggttatgcccaataattttaccccaggcatcgactgccatggtatggccccacgtccggcgggtagcaccgtgacgccccacctgtgcagcagccaatatcacgcactggttttcgatagcccgtgcacggagcaatgtttcccaatgcgcctcacccgtcattttggtaaaggctgccggaacagaaatgatttcagccccctgcgctcgcaaagcctgaaacaagccagggaaacgcaagtcatagcaaatggtcatgcccaagcggccaaccggggtatcaaccaccgtcaactgctgccccggctgataagtatcagactcacggtaatggccatggatgtcattgatatcgacatcaaacatgtgaattttatcgtaacgggctttgagttcgccttgatcatcaaataacaagctactgctggtgatcaggtccggtgactcacggctcaccataggcatggagccaacctgtatccaaaccccgtagcgccgtgccatttcacgcacttcttgctgtaatggaccgtcattatggtgttccgcatggtgacgataagaggcagcattagcaaataacaacgcattttcaggcgtcataaccagtttgatacctgcatttaactgtttgatctgctgctcaatttgagccagattgtcacgggtattttcaccgctgcacaactgcaataatgcaacattggcatttttcatggcgcctcattctcctttagctgacgtaacacttcatggatggtcggttgatccagactaccggtaatctgatagcggatcagcgaaaccttgctccataacggccctaaaatcttcgaggcagcaaacactgccgcccccactatcgggttgatcgcaaaggcggtggcaacacctacagtggcggaaagttccggtgtgatgaccgcttccatggcgatttggcgcttaaccagatcaaccttgccattcatggcgatatctgccgccagcccatcaatcactaagtcattggtactcatcaccccatttttaagggtggccgtactccgaatagagtcaaatgcgaagtcacggctaaacgtatcactaaagtcgagttgaagcttacgtaatagtgcatcaaagctgaccagacgcagtaactggcccgcacggcccccaccaagatcagtgagctgccctctgcctagccgcccctttaacgtcccactgagggtattaatctgtggctcccaagggacaccgcgccagtttagatcggcgttaatcgcaaaagaggcattttttatcagggtggtcaggccaaagaatgagagggtttcatctattcttggcccgttcaagccgatgttcagtgtggttttatcaccagcgcgatcttgctgccactcgccggtaatagtggcccgcccatttcccgcctcaattaagccgttcgtcagtatcagagccgagcctttcggtgttaggtccgcgttcacccggccgatattctgccccagtatccaacatgccttacagcgcaattgcagcgcaggccaatcactgaatgatataccactgggaggctgtggcttctgcaataccgtaggctcctgcaataccgcttgcgccagcgggttatttgcctcacggctgccccattgtgggttgtaataaagataattgagatcagcatgccatggcccatagtctgccattaacaggctaccgtccacctcttgccccttcgcggtgattttcatcccacttggcaggggatcggcctgtaacgtcagttggtgccaggcctgcccacccaccaacagttcgggggtttgtaatgtcagccgattcggtaagatgacattggttttactgcctttgatcttcggttgagtgaatgatgtcgcagaaggcgaagaaaatgatgcagcaaacggcgaagcggccgtcgccagctcgggggccaataatgccagccaacgctcaccatcaatggccggtaatttaaataccagcgctttatcatcaggcaacgatggaatttttttactgtcggtttgccagatggcgcgggccagttcaactttctcgccttgcaataaccactggctgttaaaggcattgttgttacccgcgctgccagagagggtaaatgcctccagcccaccgttcacctgaacatgcagtggcaatgcctgaccgctgtttttatctagcggcgaaggtaagtgactgctcactttctttaagtctgcgctgacatcgacttgataatctggtttaccgtgttggggcaatttcaccgcaactttaccttgccaattggcactgccactgagcatcttcgcaagagaatccggtacaccgggcaatttagcaggtagccaatcgccctgtagcccaacattcaccaagaagtcctttggctgctccttcgtggtgaaattaaccgtcaatggttgcccataccagttggccgataacgtctcgctctccaaattgccatcatagaagcggaatttaccgttgatattttccagttggctttgcaggggcttaaccagcaggctgttgttattcaaggtcacttcaccgctggcatgagtgatgctctcttcttccagcgggatatccaggtgtaagcgcccactaatttttccacccacctgcaattcattcagcgtttcggccaccgaatccttaagtggtgtcgcggtaaagtagtcatgaacatcgcgcccttcacccaggacatccgcatcgacatacagcttttctttcaagtaatcaggaatgatggcgctgatattgctgccagtaaccttgcccaacagggtgtgtggcgcattcatccataagccttcattgaggaagttaaggtcaatggccaaattatctaaggctggccagtccggttgaaactggaaaaccgcattacgtagtgggacatagacctggaactgaccctctttatttttataaggaaaatcatgaggattaccgttatataccagtgtcgcattatctacctgccccccctgtagcgcctccgtcagataatcggccagtttctcacccataagcgagaccgggaagtaacgccaggcatcggtggcatcatacaggcggatgcccgccagtattttcagccacggctgggcttgattaagctgcgacggcttctgattaggctgcatataataaaaactgccgttgccccacaacgatttagcctggacatccagttgatcactccacagcgcccagcctttatcatcaatacgccagtttagcgcgccactcgcctggctaacctccaacggggcgcggaacaggtcaccatacggcaagagactgtttttaaggttgatgttaagacgcccaagacgtgcggagccactcaactcaccatcaaaatgattaactccgggtagttggccccagtactgccaactgacatcgtgccatttggcttgaaaacgggtggtctccggttggctgatagggatatccaacgccagtgcatcgacatacccttgtggttgtaaatctgcccagcgggccagcagttctggggtaaaaggtgacagggtgggtaacagcggcccaatccgttccaactgaagattgctggctcgaatacgtaattcttgacgctgctcagggccaataaattgggtattctccggtagccaaagggccgataagcgccctttcggccaggcttgaccatcggtttttaggttcagtactggcgcgtcgatttgccaaccattgccctgacggcggccttccagcacaaaattatcgacagataattgatgtgaattactgcccaccgtccaattggcctgcccctgactgagcagcacattaccccggtaaatttcaccacttttaatgctcagccaagccgccaaactgaattcggcattatccagaccggtattattctgcaaccaacggctaatccacggtttaaggtcgatattatcggcctgcatatataccgtgccattattcagaatgccctgattatcgtgcaaatccatacggacctgcaccacaccgtgctgaccattaatggtcgataggctaatttgcccttcggcacgatggcgggtgctggaattgagccaggtgagttgtgggatttccagctcggcacgggggccagatggcgtcagaaaagagatgcggctattacgcagatcaaaacgatctaactggcgcaggaagatattatgaacattaccggtttcaaggttactgccgttattctgcgtcgcatccagtgtggtgtgcagatccaactgcaactgatagaaggtcaaatcacggaattgccaacgccagtgcagcagtgactgccacacatccagtgccagcgtcacccgttgaacctgcaagtcagccttcggcatttgggcgcgaatatcgcgtaattccaacgtcgggccaaatgtttcccaggttccctgcataaaccctacgtccagtgggataccgctgaccgactggatcttagccacaatttgcggccgatactcattaatgagaggcagcatcatgcgtagcgcactgaccaacagcgccaccacaacaatgattgtggcgcctgtcgcaaacattattttgggcagtcgcctcacgcctttctcctttcaatccgcagtgagaccatgacgctgcaagggccacagcggaaccgtcttagaaccttcgccaacaacacgggaaggcccttacatcatcaccacgtcaaactgttcttggttatacagtggctctatttgaacttttacctgcttaccgacgaagatttccacctcggccagtgcatgagactcttcgcctttcagcgcctcacctacagccggagaagcatagaccaagaaacggtcagaatcataagcatgatgaacacggacaatttcacgcaagatttcgtagcacacggtctctacggattttaccgtgccacggccacggcaggttgggcattcatggcataaaacatgctcaatactttcacgcgtacgcttacgcgtcatttcgactaagcctagctgggagaagccgttaatactggtttttacgcgatctttactcagtgcttgttccaatgaatgcaatacccgccggcgatgatcttcattactcatatcaatgaaatcaataatgataatcccgcccagattacgcatccgcaattggcgggcaatggcctgcgtcgcctcaatattggtattgaaaatggtttcctcaagattccgatgcccgacaaatgccccagtgttaatatccacggtagtcatcgcttctgtctgatcgataatcagataaccacctgattttaattcaactttacgctccagagagcgctgaatttcattctcgacatcatagagatcgaaaataggttgcttcccagtatacagctccagcttgtccgtcatttctggaatatattcgcgggtgaactccaccagcaaatcgtaagtcaattttgagtcaacgcggattttatccagcgccgcaccagcaaaatcacgcaatacgcgttgcgccagcgccatttcaccatacagcttatatttggtgatattacgcttcttacgctcctgaactttggtccacaaacgtttaaggaacgcggcatcggcggatagctcttcttcgccaatcccttcagcggcagtacgaataataaaaccgccctgctcatcacagtaagctgccaccgtcttttttaggcgttcgcgctctgcttcactttcaatccgctgggaaaccccaacatgggcagctccgggcattaacaccagatagcgagaaggaagagtaatatcggttgtcaaacgtgcgcctttggtacccaagggatctttcaccacttgtaccattaaatcctgcccctgacggaccagttcggcgatatcgcgcacattgaagtttttctgttcatccccggccacgcattcggtgtggggcatgatatcggaagcatggaggaaggcggctttatccagacctatgtcaacaaaagcagcttgcatacccggtaaaacccggctgactcgccctttataaatattgccaacgatccctcttttggcttcacgctcgatatgtatttcttgcaggatgccgccatcaatataagcaacacgcgtttcagacggtgtaatattgaccagtaattcagctgtcatgtattcctctcacattacgctgcgcaataaaatgacttagtaattcatgggtttcaactaacggcaggcccaccactgcgtgataactgcctgcaatggccctgacgaagcaaccacctttcccctgaatgccataagcgcccgccttatccatgggttcaccggtagcaatatagtcactgatttctaacggagataacacgcgaaatgtcacatctgtcacaaccatggccgataacatgttttgccgatcggccaacgccacggcggtcatcacctgatgcttctggccagacaatgcactcagtatttgttgtgcatgttccttatcccgtggtttttctaaaacctgcccatttaacaccacaatggtatcggcacccaataccggtaaatcctgtggtgcgacagccacacctgcccgtgctttatcctgcgccaaacgctggacatacacctgcgcactctcgccagggtgacgctgctcttcaacctctgttttcagtacctcaaacggtaaatccaacagggccagtaattcacggcgacgtggcgaagcagaagccagatacagggcagtcatgggcattaaatccttattgcaccgaaaattggcggcgaattttacgcattagcaggaatagccatggccagagaatgccgttgacaacgctactccagaaaacttcagggcggaatgcgacattaatcaccaagaactcagaccaaaacaccacaacatccatcgtcagcgaaagcagcatgacgataagtgcctgttgccacagtgccatattacggaataactgaaacttaaaggccaccagataggcgatgatactgaatgccaacgcccggactcccagagtcgatcctaaaataaggtccataatcagccccagaataaaccccgtgccaacattcacccggtgtggcaaggccatcacccaataaatgagtaccaaggctaaccatgagggccgaaacatatagatctgttcaggccacggcataatttgcagcaccatcgcaatcaggaaggatagccagataacccagcgaccatgactactgtaacgattcacggcgaaactcctggtgtgacaactcctggtgtggcacccgcgggcgtggatgcggcaggcgctggcggccccatagcatcagcagaaggcaacacctgagacatcattggtgccagacgttcattggcgacccggcgtacctcatccggtggcattggcatatcaccattacgatcagcgccccacaatagcagtaaataacgtaagcgttgtaaatctgcggtgggccgagcttgaataaccgtataagcgcgctggttgtcgactttgaccgaagagacaacggcaacgggatagccttcagggaagcgcccacccaagcccgacgttaccagcacatcgcctacacgaatatctgtattactgggtaaatgctccaataataaatcatcgctacacccgctaccggcagcaatcacccgaatatcattacgcagcacctgaataggcagtgcatgggaagcatcgcaaatcaataatacgcggctggtaaatttactcactgcaacaacctggccgacgacaccgcgatcactaatgaccggttggccctcataaacgccgctgttcgagcctttatcaatcacaacatgatcactataagggtctgtcccgctggacatgacctgagtcaccattttttgctcatcctgacgcagaggagaacccaataattcccgtaagcggttgttttcctgtttaaactgccccagtaattgaagatcggtatttttcagtaacagctcttggcgtaacgcacgattctccaactccagttgttcgcgagtggctagcgtatcagaaacgttgtcgagaattttacgtggcccattggccagaaaatagaaagggctaactgcggtgtccatgtaagtccgtattttaacgaacgtacccaaccggctatcagcaataaccagtacaatggccgcaataatggcaaagaagagtcgcagttgcagggatggaccccgactaaaaatcggcttcataaattatgcgtattcctcgacgacaagaggagacactaaatcgggtaagtaaaataccttgtcacttgaaattacagcagtgttagcgttattcattcgcccgaatcactgacctggatcagcgcatcgggattcgctgacttgctgcaaccccaattaatgttgggtatagactcaaccgacctagccctcttctttggctgactattcttcgctgaacaaatcgccgccatgcatgtcgatcatttccaacgctttaccgccaccacgtgcaacgcaggtcaatggatcttctgcgaccacgacgggaataccggtctcttccatcagcaggcggtccaggttacgcagcaatgcgccgccaccggtcaataccataccgcgctcagagatgtcagaagccaattctggtgggcactgttccagcgccaccataactgcgctcacaatacctgtcagcggttcttgcaacgcttcaaggatctcgttggaattcagcgtaaagccacgtggtaccccttcagcaaggttacgaccacgcacttcgatttccagcacttcgtcgcccgggtaagcagaaccaatgctgtgtttgatacgttcggcggttgcttcaccaattaatgaaccgtaattacgacggacataattaatgatagcttcatcaaagcggtcaccaccgatacgcacagaagaagagtaaaccaccccgttcagagagatgacggccacttctgtggtaccgccaccaatatccacaaccattgaaccggtggcttcagaaacaggcaagcccgcgccaatggccgcagccatcggctcttcaattaggaacacctcacgggcacctgcgccctgggcagattcacggatcgcacggcgctcaacctgagtagccccgaccggcacgcacaccaacacgcgcggactcgggcgcatgaagctgttgctgtgaacttgcttgataaagtgctgcagcattttttccgtgacaaagaaatcggcgataacgccgtctttcattggacgaatagccgcgatattaccaggagtacgccccagcatctgtttggcatcatggccaaccgctgcaacgctctttggtgaaccggcacgatcctgacgaatagccaccactgaaggctcattcagtacaatgccttgtcctttaacatatataagggtattggcggtacccaagtcgatggacaagtcgttggaaaacatgccacgaaatttcttaaacataacgaaaggataatcctgcaagctgggggcgaaaaataaaatccgcctactttaccaaccacacgaatcagcgacaaggcgcaaaaacgtcctgactcggtgaaaaagtagctgcgtcagtcacatcgcgttccagtcaaaatctatattgcttgaaaaggttaagtaaaccctctgtacaacacagatttgcccgcacggcagacgtaacacagcacataaaatctaacatttaacctgattctcgttgaaagtaagtgcacaccaacgattcacggtaatgactgacacattctacgttaatttttgctcaacgatcaggctaacatggccctattacgaatattttttctttccggagtttaatggggtcggtggagcaaagaaattgccctgtccgccgtaaacgcctttctcttgcagcgtttgccattcttcacgggtacgcacttctgccgcaaaaactttcgtctgcgtccctgcacaggcaccggtcagactttctacaaataactggttttcatagcgaaaattaatgcttcttaccacaccgggatgaagctttatcatttcaacctgcaaagacttaatatatgaggtgctgacaaccgtcaatccagcctgtgatgccatcactttgcagcctacgccacgcaataaacggaccatttggcggatttcttcgatatgttgacacacatctgcctctgcaagttcaaagataattcgcattcggtcagattttttgcactgtaatagcgtgtcacgcaaccagcgctggaaaggacgatgtaataatgaatcaacgctgatagaaaatgccagcgtttcatccggccataaagataataaaggaattatcttatcaatcttttgccgatcataacgttcacccaatccgagcaattgtaccaagggcataaactcggccgccagtagctcctgctcaccatcatatatgcggctaattatttcacgatggcttattttgccatcaacagtaataacgggtttttgataaagccttgggcctccgctcgccagagtctgttccagtaatgtacgccatttaacactgccacgtccgcgctccggtacctgagtgtcgaacacataccaaccgttgccaccatacagcgccgcacttttggtcgcctgcccggcattgtccataatttgttcgactgactcaccactccggtaagccacgatgccaatacgcaacagtgattcacgatcaataatatgaggctccggtaaggttctcaccgcattcaccaactgtgcggccatcacatcggcatctttcagggttttgtggggcagtaatatcgcgatgtcactattaaggtagcgggccaagagtgctgaggggtagcgggccacaaaagttgacagcaggttaaccagtgaactcatcaattcctgtacttgctgctgatcatgcgtttcatttaaggcttcaaaatcgggcagttgcaccatcatgaccacgccgtgcgcgccggtctcttcaagttgtgtggtcagttggttatcaaaaaactgacggttactgaggccagtctgagcatcttgagccgcaaacgtgcggattaacgtatctacccgattgcgttctgcccgcacctccatcaactcagataataaatggtcaatagccctgctggcacaaggtggccattcgtaatcctcgctgcgcaccgcatgttcacgttcaccattgagaatgcgccttgctcgccgttcaagtttttcctgccccacggtctggtcacgtagccagcggaaactcaacaacaacgttaacgcaatgaccaccaccaccagcgataaaatggccgcggcataaatagaacgggcatagctgcccaacgggtcaatatagttgaaatgcatctccgcccctggctgatgcaacagaggcaataccatctgacggtaacgactgtggctgttccaaggcgtataaactgcaggaatgtggagttgatagagggtactggtgctatttttgacactgacatcgaccacaccaagggtctgcatcatcagtggcagccattcacgttttttattgatgggttgcagcagcagtgactgatcgtaagcggtcacaatactttggagccgttgttccattttcttctggcacaaatagaagaagctgatcgtgctgcccaataagactaaacacatagccaatacgaccagcagcgtcataaacgcagaaagtttggtggtaaatcgcattacttagccttgcctagtgcaattgaatgaatagagtccctcaaatccatgggggcaagtactatatgacaaaaataacccgtaacgctgattttttactgcagaatacggcaaatacacaataatttagtccttttccctgacgttcagcttatccctctaacaagcatagcccctgataatcatcaacagcatgatttttgtccccgatcagccttgaaatttgctgtaaccgctatattggctcacccttaacacagggtttttatttctgtcttttcaccatttatacccaacgttattgacattgccgtaagcgaatcacccatcgtccacgtcacgagagcggctgacacggcggcaacgttaagtaagaagaggggtcattagggagcacgacatgcgagcactgatacttgagcaaattgaagggcgtaccaccgcagaagtacgtcaaatttcggcctcacaactgcctgcgggtaatgtcaccgtagatgtcaattggtccagcctgaattataaagatgcgttggcgattacggggcaagggaagattattcgccagtttccgatggtaccgggtattgatttcgccggcacagtacacagcagcgaagatccacgttttcatatcggccaatcggtcttattaaccggttggggagtaggtgaaaaccattggggaggactcgccgagcaagcacgagtgaatggcgactggcttgtccccatgccagacggactggatgcacgtaaagcgatgattattggtaccgcaggttttaccgccatgctgtgcgtcatggcactggaagacggtggtgtgaccccgaaaagcggtgaagtggtagtaaccggggccagtggtggcgttggtagcacagcaattgccttgctttcagcgttaggctaccagattgccgctatttctggccgcgacagcaacagtgactatctaaagaacttgggcgcacaacggatattaccgcgcagtgattatcttgatgcttcacgaccactggaaaaacagctctgggcaggggcgattgatactgtgggtgatagcatgttggccaaaatactggcccagatgaattataacggtaccgtcgcggcgtgtggcctggcaggcggttataatctgccaaccaccgtcatgccatttattctgcgtaatattcgcctacagggcgtggattcagtgatgacaccacaacctcgccgtctgcaagcctggcagcgattacagaaaattttgcctgaaagtttctatcagcaagcatcacaagccatcacgctggctgatacgcctacgattgcggccaggttactggcaaatgaagtcaccgggcgtaccttagtcaaagtccgctgattttttcttattcgctgacggcactcaatttactggcgacactcacccccactaattaatcgttacagcaaccaccgaggtcagtttcacacttgcctcggtggtagaaatttcatatttttcttagaaccttcgcacttgttcccatttgccaccatgattaaccacatcaggggcaacgcgattaacgacatcaagggcaactatccgacggagtctgctatgcataacacgtttactcatactaaaaacaatactcatactaaaaacaatactcaggctaaaaacagcggttctcagacgaaaagcaatgcggtcagtctcaataagccacgaaaactgactgaggcagatgtcacgccagagagtattttttatcaacgacgtaaggtgttgcaggctctggggatcaccgccgccaccttggctttgccagcatcagcacaagccgatttactggcctggtttaaaggtaacgagccgcccaaagcgccctcaggtaaaccattgacgttcaccccatcagccgcttaccacccagacttggctttaacgccagaagacaaagtgaccgggtacaataatttctatgagtttgggttggataaagctgatcccgccgcgaatgctggcacgctgaaaacagaggactggcagattaagattgacggcgatgtcgttaagcccatgacgttggatatggattatctgatgaaatgctttccccttgaagagcgaatctatcgcctacgctgcgtcgaagcgtggtcgatggtcgtgccatggatcggttttgagttagggaaactgctgaaattagcagagccaaccagtaacgcccgctatgtggcgttccaaacattgtatgctccagatcaaatgcctgggcagaaaaaccgctttattggcgggggactggactacccctatgtcgaagggctgcggttggatgaagccatgcacccgctggcctttatggttgttggtgtgtatggcaaaaccctgcctccgcaaaatggtgcgccgctacgactcatgacgccgtggaaatatggctttaagagcattaagtccatcgtgcatattcgcctgacacgtgatcagccgccaaccacctggaatttgagcgcccccaacgaatatggcttttatgccaatgtgaacccgcacgtcgatcatccccgctggtcacaggccaccgagcgcgttatcggttctggcggtattctggatgtaaaacgccagcccaccctgttatttaacggctatgctgaccaagtggcatcactatatcgtggtttagatttgcggaagaatttctaatgcggctcagtttacgacacatcacatggctaaaaatcgccatttggctggcggcaacattaccgcttctgtggctcgtattatcgatcaatctgggggggctcagtgccgatcccgccaaagatattcaacattttaccgggcggatggcccttaaattacttttggcaaccttattggtctcgccattggctcgctacagtaaacaaccgttgttactgcgctgccgccgcttattaggcctatggtgttttgcctggggaacactgcatttactcagctactcgatattggaactggggctgagtaatattggcctgttggggcatgagttgattaaccgcccttatctgacattgggcattatcagttggctggtgttactggcgctggcgctcacctccacccggtgggcgcaacgaaaaatgggcgctcgctggcaaaaactacataattgggtgtatgtggtcgccattttagcccctattcattatctttggtcagtgaaaacactctcaccttggcccattatctatgcggtgatggcagcactattactgttactacgttataaattactgctaccgcgttataaaaaatttcgtcaatggttccgctaaaagtccgaaccgctcatcgcttcccccctgtaacatcccgtgtgcagggggtaaatcgatgagtgaacgcacagttcgctattttttttattgaatatcttcgctgataagaccagtatttagctgcgaattgctacgatatcattataatgcccaaccttagtgctgatcgccgtgccagtttcgtcgtaaaaaggtgacaaatcggtagcagcaggttattttttacgatgatggactaattgccggagataccagcacaatgtcggataagtttcacattttgcttctgaatggccctaacttgaatctgcttggaacgcgtgaaccagaaaagtatggttacaccaccttggctgaaattgtcagtcagttagagattcaggctcagggaatggatgtcgcgctttcccatttgcagtcaaatgcagaacatgcgctgatcgatagcattcaccaggcacggggtaataccgattttatcctgattaacccagcagcgtttacgcataccagcgtggcactgcgtgatgcgttgctaggcgtgcagatcccgtttatcgagatccacttgtctaacgtgcatgccagggagcctttccgtcatcattcatatctctccgacatcgcggttggcgtaatctgcggacttggcgcagatggctacaactttgctttacaggcagcggtaaatcgcttgtcaaaatccaactagacccgaaataattcgagttacaggaaggcggcaactgagcgaatccccacgagcttacataggtaagtgactggggtgaacgaaggcagccaacgcacatgcaactcgaagtatgatgggtataattgcaacacacaaagagtacggaatcacacttatggatattcgtaagattaagaaactgatcgaactggttgaagagtctggtatttcagagctggaaatctcagaaggcgaagagtcagtacgtatcagtcgtgctcctgccgcaccgaattacccaatgatgcaacagccttatgcttttgctgcaccacaacagcagccagcgctggcagccgcagtcgccccagcacccgttgctgaagccgcaccggcagcgataagtggccatatcgtatgttccccaatggtcggtacgttctaccgcacccctagcccagatgccaaagccttcgttgaagtcggtcagaaagtttctgttggtgatactctttgcatcgttgaagcgatgaaaatgatgaaccaaatcgaagcagacaaatccggtactgtaaaagccattctggttgaaaacggccaaccggttgaattcgacgagcctcttgtcgtcatcgaataacgaggcgttccatgcttgataaaatcgtaatcgctaaccgcggtgagattgcgctgcggatcctacgggcttgtaaggagctggggatcaagactgtcgccgttcactctgttgcggatcgtgacctgaaacacgtattactggctgacgagactgtttgtatcggtcctgcgccttcagttaaaagctatctgaacatcccggcaatcatttcggctgctgagatcaccggcgcagtggctgttcaccccggctatggtttcctgtctgaaaatgctgattttgccgaacaggtagagcgttccggtttcattttcattggcccacgagccgaaaccattcgcctgatgggcgataaagtttccgctattagcgcaatgaaaaaagccggtgtgccatgcgtacccggttctgatggcccattaagcgacgataccaccaagaacaaagcctttgccaaacgtatcggttatccggtcattatcaaggcatctggcggcggcggtggccgtggtatgcgtgtggttcgtcacgacaaagatctggaagaatccattaacatgacccgtgcggaagcgaaagcggctttcaataacgacatggtttatatggagaaataccttgagaacccgcgccatatcgaggttcagattttggctgatggtcagggtaatgctatctatctggccgaacgcgattgctctatgcagcgccgccaccagaaagtggttgaagaagcacctgcaccaggtatcaccagcgaaatgcgccgttatatcggtgagcgctgcgcgaaagcctgtatggaaatcggttatcgcggtgcaggtacctttgagttcttgtatgaaaacggtgagttctatttcattgaaatgaacacccgtattcaagttgaacacacggttaccgaaatgatcaccggtattgatttgatcaaagagcagctccgtatcgcggctggccaacctctctccatcaaacaagatgaagtgaaagtgcatggccacgctgttgaatgccgtattaacgccgaagatccaaataccttcctgccaagtccgggtaaaattacccgcttccatgcaccgggcggtttcggtgttcgttgggaatctcatatttacgcaggctatactgtgcctccgtattatgattccatgattggtaagctgatcacttacggtgaaaaccgtgacgtggcgattgctcgtatgaaaaatgccttggcagagctcattatcgatggcatcaaaaccaacgttgagttacagcaacgcattatgaatgacgaaaacttccagcacggtgggactaatatccactatctggagaaaaaactcgggttgcaagaaacctgatatttcgcctttcatacatcatttgagctgttatagcagggccggttaattgaattgccccccaatattggataataacctgatattggggggcggttttttatggcataaactgaagttaaaaagcctgaattctgtagagtgcggaattcaggccttgatggctaattaatttaaacaaccaaaaatcttgttaatttaaacagccgtatatcttaccttcagtttatttaagctgaaattttttaatttgctcctggcaagcattggaaaaaatcttcctttccattttcatcgtatgagaccattgcgcctccgccttgtgggcatctgtctaagtgccagttaataccagatgcatatactggagctatggaagaactggcacatactaatagaagagaggcaatgatttttttcatggtaaattcctataaattttaagttaatgtttatattgataaaagtaatttatcagtagtcaatacaattatttttacaatgtgatttcctaccaccaaaacaatattaaaaagaacaaacccaatcaattaaatttattatcttttcatgttattaatgattggtaatcatgttattaggggtctaatatttaaattatttttttaattttatatataaaaaagaaaaaaataaacagcgtcaatggaaaatctattttagccaataggttgcaataaaaatccaatattaaatctagaaaataatatttattatagataatatcggttattccgtggagtgagtgttaaaaacagtatttataatatattcacggttaaaaaaaacaggtccggtaccattgtcgtcaggaaccagcagcctccagactggctgaaaacaacatttgaatttccaatgtgattgagacaagaaaatggatggccttagaatattttatctaaaccgttagcttcagctaaacaatgggctgtttatgaaatatcattccgaccggttttttcttttctgcaacggatctacccaaaacaagacagtaaatgaacaagtcccgatgagttgattcgggtgagtgagtgccgctaacaacgctgtagcgccaaatacgaagggagttacccaatggagttggtgtggcagctaggcagcaagcgaatgaatcccgatgagctgactcacgtcagtgattcgggtgagtgagtgccgctaacaacgctgtagcgccaaatacgaagggagttacccaatggagttggtgttacagctaggcagcaagcgaatgaatcccgatgagctgactcacgtcagtgattcgggtgggtgagtgccgctaacaacgctgtagcgccaaatacgaagggagttacccaatggagttggtgttacagctaggcagcaagcgaatgaatcccgatgagctgactcacgtcagtgattcgggtgagtgagtgctgctaacaacgctgtagcgccaaatacgaagggtatggggagaacatatggaaacaagattcctacaggcaaacaaagaagcacgctgggccttcggcttaacactggcctacctcgcagggtggattataaccgcttacttaccgggcaaccttcccggaatgagcggcctacctgcttggtttgaagcggcctgtatcgcattaccgctcctgtttattgtgctgtgtattctgatggtgcggctgatattccgcgatattccactggaggatgacgatgcaaactgatgtcgttctgccgttagtcggctatctggtgttggtctttggcttatctatttatgcttatacgcgccgccaaaccgggaattttctcaacgaatattttatcggcaaccgttcgatgggcggttttgtattggcgatgaccctgaccgccacctatatcagcgccagctcgtttattggtggaccaggtgccgcttataaatacggccttggctgggtcttactggcgatgatccaattgcctgcggtctggctttccctcggtgtcttaggcaaaaagtttgccattctggcgcgtcgctataatgccgtgaccctcaacgatatgttgtatgcccgttatcagagccgtttactggtttggctggccagtatcagcctgctggtggcttttgtcggtgccatgaccgtgcaatttattggtggcgcacggttgttagaaacggcggcggggatcccttacgacactggcttattgatttttggtatcagtatcgccctgtacacctcgtttggtggcttccgggccagtgtcttgaatgatgccctgcaagggttagtgatgctgatcggcaccattttactgttagtcgcggtgatccacgcggcaggtggcctacacaaagccgtcgaaacgctgcaacatatcgatccggcgctggtttccccccaaggcggcgatcagatcctcgacgtgccatttatggcttcgttctggatcctggtctgttttggggtgattggtctgccacacaccgccgtacgttgtatttcgtatcgtgacagtaaagcggttcatcgcggtattatcctcggcaccatcgtggtggcgatcctaatgttcggtatgcacctggctggcgcgctggggcgggcagtgttaccagatctgaaaattccagatcaagtaatcccgacactgatgatcaccgtactgccgccatttgctgcggggatattcctggcagcaccgatggcggcgatcatgtcgaccatcaatgcccagttactgcaatcttctgctaccatcgtgaaagatttgtatctcaatctgtggccagcagagttaaagaatgagcgcaagctggcacgtatctccagcttatccacactcattcttgggctattattgctcttggccgcctggcgaccacctgaaatgattatctggttgaacctactggcctttggcggactggaagcggtattcctctggccattggtattgggattatactgggagcgagccaatgcccacggcgctcttagcgccatgatcgtcggtgcggtatgctatacggtattagccagcttcgatatcaagatagccggcctgcaccccattgtgccgtcacttacacttaatctgttggcgttttatatcggtaatctgtttggcgacagagcgcgggcgcgacaccccgccatcgtcagtgccgattaaaatcactattactctatcaacacatcagccggtatcgtggttatggccccgataccggcgcttgagagaattgctatgccttggatccaactaaaattaaacaccaccggcaaccaagccgaatccctaggggacgttctggtagaaagtggtgctgtgtcggtcacttttcaggacacccacgataatccggtcttcgagccactgcctggtgaaacccgtctgtggggcgataccgatgtcattggcctgtatgatgcagaaaccgatatggctgacgtggtcgccatgttggaatgccacccgcagatcggcaaaggctttatccataaaattgaacagttggaagataaagattgggagcgtgaatggatggataacttccatccgatgcgttttggtgagcgcctgtggatctgcccaagctggcgtgatgtgccagatccaacggcggttaacgttatgctcgaccccggcttagcctttggtacgggtacccaccctaccacagcactatgcttacaatggctagatagcctcgatctcaatggtaaaaccctcatcgatttcggttgtggctctggcatcctggcgattgccgcgctaaagctcggtgcagcgcgcgctattggcattgatatcgatccgcaggccattcaagccagtcgcgataacgcgcagcgtaacggcgtttcagagcgtttggagctgtatctggcaaaagaccagcccgcagaactatctgctgacgtggtcgtggccaatattctggcaggcccattacgggaactggcactactgattagcgttttaccgacgacgggcggccatcttgggttgtctggggtattagcaacacaagcggcgggcgtcgcacaggcctatgaggataaattcattctcgacccagtcgccgagaaagaagaatggtgccgcattaccggtatcaaaaaataattttgccttaactggcgcacacggacttgagtccgtgtgcgccacaactcacctttcaacgccagccacctttcatcatcaacaatccttcatcatcaacaatatttctgtatcgataatatttcagtattaacagcatttcagtatcaacaacattaacatttcagtatcaacagcattgcaccgtcaggtgagaacggcatacccatgattttactatggaataacgatagggtttctggcttttagccgccctttatctcatcttctttttaattgcaacgagatgtgtgacagatatatttctactctttatctttgatttgatgaataaaacagcactatcgaccctatttttgatactttcccagttgataattatgttgtttgacagaaaatactaaagcgcacaattcaaccagataagcgtaacgtgatgttatttataattaaatatctagaaatacaacgttaacctattattcattgctcttttttcatcaattggtcaaagtttggcctttcatctgggcgcaaaaatgcgtaatatacgcgcccttacggacacagtgtggtcattctttgtctatgcgtattggacacttccagcttacaaattgcctgattgccgccccgatggcgggtatcacagatcgccccttcagagcgctatgtcatggtatgggggctgggatggctgtatctgaaatgctctcctctaatccagaggtttggcgaacggataagtcgcgtttacgcatggtccatgttgatgaacccgggattcgtaacgtgcaaattgccggtaacgatccagatgagatggcagcagccgccagaatcaatgtggcgagtggtgcccaaatcatcgatatcaatatgggatgtccagccaagaaagtgaaccgcaaactggcgggttctgcattattgcagcatcctgatctggtcaaacagatcctctccgcagtggttaatgcggtagatgtgccggtgacgttgaagatccggacgggttggtcaccagaacaccgtaactgtatagaaattgcccaactggccgaaaattgtggtatacaagccctgacgattcatggccgaacccgttcttgcctgtttaatggtgaggcggaatacgacagtattcgagcagttaagcagactgtttccattcccgttatcgcgaatggtgacatcactgacccgcataaagccagagcggtactcgactacactggagctgatgctctgatgataggccgtgccgctcagggaagaccgtggatcttccgggaaatccagcattatctggacactggggaactgctgccaccgatgccacttggcgaagtgcagcgtttgttagacgggcatatacgggaattgcacgacttttatggtccaggcaagggatttcgtattgcacgtaagcacgtctcttggtatctccaagagcacgcccctaacgaccagtttcggcgcacattcaacgccattgaggatgccagcgaacagctggaggcgttggaggcatatttcgaaaatcttgcgtaaacagaaaaaagagctgacagaactatgttcgaacaacgcgtaaattctgacgtactgaccgttgcaaccgtaaactcacaagatcaggtgactcaaaagcctttgcgtgactcggttaaacaagcactgaagaactattttgctcaactgaatggtcaagatgtaagtgacctgtatgagttggtactggctgaagttgaacagccattgttggacatggtgatgcaatacacccgtggcaaccaaacccgtgcggccctgatgatgggcatcaaccgcggtacgctgcgtaagaaattgaaaaaatacggcatgaactgatactagtcagttaaaatgttgtttaaaaaggcgttttccttaattggttagcgccttttttataataatggctacaccatggactacacagactggtgaacgaaagtagcctcgtgctgtacggacgggaggaaggcttgaacgtgactctttgttactaactggctggctttggaacgctcaccatcgcctttagctttaccgccagcccttcggtatgcctcggtctgattggcaccctctagcagcgcggtaacgaatctgcactgtaattgcgtcagggcatcgaaaagcgccttttattcttcggtgagcgtcatttcgataccttaggcttgaccggtatagaattttctcattaataatgatagcgagggcctttctgaacaaaatagtcagtgggctatttatttagagcgtcctgatttagtttattgatgagctgtagaacttgttcatatagttgcttatcgtcaagttcatattcctctctgtctgagtcaggattatagagatcagccaaacaaaatatacttgataagcactcgcttaatttttcattgtctttaagacagatacgttggtcacgctctagcgagtaaaccttactctctgttgacgtatgggtgcccgcccgtgaaagaacacctgaatgattaagaagacataccttccttggccactgtccgttaagttaaataagagccagactctctgtattttacagtccagcctctagtttaacattgcaaattattctattaatggcatcagtgatatcaacaagccaacgatatcatcgtagctttcattgagcctatctagcccaatgcggtcacggttctcatatgatccattttttttattgaagataagaatatctgtatctgtttcaccaatcagaacccaatcgttgaacgcatcagggaacaattcaggaaacgcttttaggtcagccaactgcttacgtaaatctcgttcatcacctttatcatcaaaatagccgaatagccgaacaccattaagatcaaaaccatttacattacgtagaaatggcagatagctctccgcaaaatcatcaccgcctaacagggtaagtgcatgatggcagggtgtaacttgatgttcgttaattccgttcctgtcctcataacctgcggcaaggcgtgatttagcaattgtatgaatcttgccaattaacgtgctaagttttttgttttcagtattcatgctgaccgctatggatagattttcccgttaggtatcggcaaaaggattgcctatgtctttattgcctacgtcgcgttggtctcctcaaggatccgcagagcaacttcttttgcattggcgacatgccgttctgccgctgcctgtgccgcatcgggatcccgcgcttttaacgcctgatacagatcgtcgatctcattaatgctgacaggtaaacgctgcggatccattagcgaagtcgcgcgcaataagttaatccgcgaatgtaagctggttaaggtctctttcaccaacccattgccacaattgtccagcaacacgtcataaagatctgttttcgccttcagtaccttggcccgatcctttgtcatgcctgccatgcgcagtgcctgaatagcttgtgcgaaatgcacaatcgctacatccgttgcccgttgggcaaattcacgggcggcgaacccctccaagagaccgcgcagggcgaataactcagcagcttcttgcctggagataatcgccactatcgggcctttgtgcggcacaatggagaccagtttttcagcttcaagcctacgtaaagcttcacgaattgatgtccggctgacgcctaaggtttcacacagttctcgttcaatcagccgctcccctggtgtaaaacgccctgacatgatcgcttgccgcagtacattttcaacctgatagcgcaaggtctcaggtttaatcacacccattcccgctagcattaattgtattcctgtccgacaatatggttgctttttgtaccatacctctgtaatacaaaacaagaaaagacccggtgataatccccccgttagcccgctgacgaggtaaaatcgacctctttagtttccggccccataatggcccccaccgtacctatcatcccccccagcgccagtaacaccaccgcagtcagttcaaagggcaccacgacactgagccagtccatatagaaagcataaaaagagggaatgatgacggataagctaaacccagcaccaaacccagtagcccgtacgccagtggcgaaacgctcattaatatacgtgatgatcaccccccagggagaggtcaccactaccgccaatagacagaccaacagcataacggtactaaatgataagccatcgccatgacttaatacgtagagcagcgctgaccccatagttgcaatcaaggggcctgcaatcatgaagaaacgccgccgcccgattttttgccccaacatgcccatgccgatatagctgaagaaaagcacgcaataggtcactaacaagatcgatgtcacctgtagccccctcatattcagggtattgattagcagcccggtggggagaaaaagggtgataagattttgcgtcagccaaaaaccgctcatcatcagtaatacctgccataaattacgcccactttgtccactgactaaggttgataaaggctgtttttcacgtgcgcgtttcttgctgctgccttgttgccacacctcagattccgtgacattaaacacgtaatacagggcgaggaacccggccagtaatccaccaatcacaaaggggatacgccagccccactgcgcatacggtgaatacagcccatccagtgggatcagagcgaacatcagcatcgccaccaaattgatagcgacataggctgcagggaaaccactgaggatcaaccccccgacaaatccccgctgttcttttttagaatattcgagcgcaagcggtatcgcaccggtatatcccccgccgagaaaaatgccgtcgataaaacgcagtaataccaacaacagataagaggcgatccccagtgtttcgtagccaggaatgagcgcaatcaaaaatgtcaccacaccaaatcctgatactgaataaatcgatgccatacgacgaccaatacgatcagccataatcccaaacagtaaagcgccaattggccggcctaacagggttgtgataaagaccagtgaagccaagatattagcggtgctgctcgataaattaggtggctggaaatagaacaaaacggggggcaacacaataaccggcagatagatatcgaacatatctataaactcggaaaagaacgcgcctttaatggcatttttccttttcacgtctctcaatgggtcattttctgccgctgtaatagcagagtcagcacttaaggtttccatttcaggctcctacttctttcctatacatccttttctttcctctgcatccttgatagagatataagattgaaatctaccgcagagggcatgttattgatcgccacaaattgatcgccacaaccggtggagttggcattagacgcgaagggagtgctaactgtcagcaatctcatcgtcatacgctttgattgcggcactggcaatacgaaacgccgccagcgcgactggcgcaccgcaatacaccacggtttgtagcaacaccgcgcgtatctcctcgcgtgtgacaccatttctcagcgcgcctttaacgtgtaaagaaagctcatgatgctggcccatcgccgtgagaatgccaatattcagcatactgcgagttttaaaagtgagtgccggatccccccagatctctccccagcaatattcagtgatcagtttttgcaccggtcggttgaattcatccgaattaccccatgatgtttcaacatgttccgcgcccagtactgcttttcggttgtgaaaaccccgttcaaaacgatcttgagctaccatcatcaccctccttccgatttcataacccaccctattcgacactcacgccacaacagagtgtctgatacataacgtctgatacataacgcctgacacataacgtctgattgtatgacaggatggttagacaaaattttttccccctgacgcttcccctgagcgtaacccgaggtattcgctacgtaaggcggcccctttacggcgctatggctccttgtcgatcaacagccggtacatctcggtatggtctgccatcggtgttgcacgccgcgaaacttcatcccaaacatcgacacagtgcatgcccaatctcattgggtaattaagccgttgtgccaaattacgtgcgatatgcaggtctttattcatcaattgcagcgtaaaaccagaggcatacgaaccgttcagcataaattggcgcactttgttttctgacgtattactccggccagtggaggtattgagcacctcggtcatcacctctggttcgatcccaaaacgttgggcaacatgcagtgcctcgattgtcgccaatagccccgtcgctgagacataattattcaatgccttggccgcatgaccactccccgcagggccaacaaacaagatctgttcccccatcgcagccaaagcggtataacaagatttaagtacccggtcctcgcccccaattaggatcgacaatgtcccgttttgggctttttttaccccgccagagaccggggcatccagataatccagttcccatacagccagcaagatcgccagacgacgtgagcgttcgggatcggaggaactcatgtcgatcaccactgccgcttgagatagctgtgcaacccatcccgatatcccgtcacttcccagcaatgcctgttcaacggcctcagagttaggcaacatggtgatcaaggcatctaaagatgccgcattatcgaccgtgagtgattcagcgttgagttctgccgtcagtatttgcaccttggtgatatctgcatcacagagatacagctcaaaacccgcctttaccaggcgctgtaccataggggttcccatcttccccaaaccaataaaaccaatacgttgtagttgtttcatctgacccccttaatcgttattggtcgccagagcacgcatttaatccgttcggctgaaatacatttcacgtccactgagtgaggggggcaacatcaacctgagcgatccatgcggccgtttccggcgtgcccgctgggtaacgttgcaacaccatcggatcatgtccgggaataatatggtcgaatgaatcggcccagcgataaagtgtgttgtagccttccaagacatcgccaacgttataaaggattggataaggccggcgttgctgaatattagcgtagaaatgcgtggcatctgatgccaacaccacccagccacgggcggtgtgtactcgtatgatttgtaagccgtcagtgtgcccaccgacacggtgaacactgataccgggagcaatctcggcatccccatggtgaaactgtagacgcccagtaaacagcctccctaccatcgctttaacatcttctacatcaaaagcctgacttaagccgtgatggcccatacagcggccagtacaaaacgccatctcacgatcctgaagatgaaaacgcgcgttgggaaacaatccgtgattacccgcatggtcatagtgcatatgcgaaataatgacgtcttcaatctttcccgcatcaatgccaagttggctcagaccgtcttcaatgcaatgcgtgatggtccggccacgctgacgggccatggcagcatcaaatccggtatcaaccataatcgtgcgcgtggtccctacgatggcccagacaaaatagtcaatcggcatcggcccgtcgtgtggatctccccccagaaagttatcgcgggttagccggtggtgatgagcgtacttgatagcaaaaatccggtaattctcatgggatgcagacatatcgcggttctccatgtcaaacggcctatgcctgccaatgcgggcaatacttcaccgataacggtttacagccacgtcttcacgtccacctatagccataggtttgattaaaaaataacctaccgtaatataatcagtcaataatataaaaagtgatataacccacatattcagccaaatttgagggggggaataagcgaggggacctcagggagtttcttccgttttcgtgtgtcagccccacattaagtgagccaatgggctacctccgatctttgtggtctcaatgaattaagtatcaacatgatatttatctcttcagattaactgcaatcacgctatagtcattattaacagctatctatagtctaaataattcgagttgcaggaaggcggacaacgcacaggcaacttgaaatatgacagatatataagctgaatgaattctgacttgcactgaggaaaggggttgattatgaataagctggccattgccgttgcacttgccgccaccgtattaagcggatgtgccaataacactgcgtctggtgatacttttactgcctctcaggcacgacaagtacagaccgtcacttacggctcgatagtgtctgcccgcccggtcaccattcagggcggcaataataataatgttgccggtgccattggcggtgccgtagtgggtggattcttagggaatactattggcggtggccgtggtaatagcttggcaactgcgggtggtgccgttgctggtggcgtagcaggccagggtatccagagtgcgatgaaccgcagtgaaggggttcaactggaaattcgccgtgatgatggcagcaatattgttgttgtacaggctcaggggcctacccgtttcagtgctggccaacgcgtgataatcgccagtgatcgtagcggtaccgtcacggtttctcctcgctaaacgtagcaaccggggggcacgttaaccccggttttcagtctgtaggctgatagcccatgcctacggactggttatcaaatgccgtagtcgttaaagccggaggctaattgcgcgtagcccaccaatcatgtgagtcggttttgggctgatagtgagtgacaaagtgatggtacgcccggcccccgccaaaaatattgcacaaatttccacaggcatttaattggcgtaaaaggttgtttatccacattaaatgtaatacataacccataaaatcagatgaaaaaaccattcatgttatctatgttagtcaaacatggggttgccacagggaatgtattgtggttaaatagcttcatcggtttggaacacagaccttatgaaagcagttttagtaaagcagtcctcagttcaagcgttatcatagatatcccttctccgtgagtctcctcctaagtgcccaagtaagacatcctctgaaagacagaccacgttcgctacactattgtggcaaaataattgaaggaaatatctctatgtctaataaaatgactggtttagtaaaatggtttgacgctggtaaaggttttggtttcatctctccggctgatggcagcaaagatgtgttcgttcacttctctgctatccagagtaatgatttcaaaaccctggatgaaggccaaaatgtggagttctctatcgagaacggcgctaaaggcccctcagcagtaaacgtaatcgccctgtaattcagtgtgattcgaggcgttggcaaccgacagcgatgacgggttaccccgagcagtgttgccagcacccacgtaaaaagttatacccggttgaccgtaacatttatgtccgcagttttagtaaagcagttccccgtattagcgttatcagacagatacctcttctccgtgaaattccttctaagtgccccataagttctacccaagcctatctggtcgcctgtggcggcaattaaaaattattgaaggaagtatctctatgtctaataaaatgactggtttagtaaaatggtttgacgctggtaaaggttttggtttcatctctccggctgatggcagcaaagatgtgttcgttcacttctctgctatccagagcaatgatttcaaaaccctggatgaaggccaaaatgtggagttctctatcgagaacggcgctaaaggcccctcagcagtaaacgtaatcgccctgtaattcagtgtgattcgaggagttggcaaccgacagcgatgacgggttaccccgagcagtgttgccagcacccacgtaaaaagttatacccggttgaccgtaacatttatgtccgcagttttagtaaagcagttccccgtattagcgttatcagacagatacctcttctccgtgaaattccttctaagtgccccataagttctacccaagcctatctggtcgcctgtggcggcaattaaaaattattgaaggaagtatctctatgtctaataaaatgactggtttagtaaaatggtttgacgctggtaaaggttttggtttcatcactccggctgatggcggcaaagatgtgttcgttcacttctctgctatccagagcaatgatttcaaaaccctggatgaaggccaaaatgtggagttctctatcgagaacggcgctaaaggccctgcagcggtaaacgttattgcgctgtaaccgtcaataatatctcggtgtgactttcaatcgcgatgaaggcgatagcccaaagcaataaactcataccgaataaaaagaacctgcctccgtgcaggtttttttgtgcctatgacaccggtactgatataaaaaacaccgcactaccacgagctcctgagtcaccggcagacatcatcgcggctcagaagaatcacgttaccggacaagaaaccgttatatggctcaactatctcaccatccttgcgggatcccccttcattcatctggaacaatgtgaaaccgttgtttagtatgtcggtattctgcctacgttatcagcaaatcctatatttatgaaaaaactcattaaacggctggagatcatcaaaagcggtattgagcttgaagatgacgacattattcgccaccaactcccctatcttaaaagtgagactcaggaccctgtgctggtttttatcgtcatggcgattgaacagggaaaattcacccaagctttggatgcgattgcaacctggctgggaagcaagcaaggggtcatacagtggcaggatattgaactggccgcttgcaagcttgaactgaaagccctggaggaacagttaagcgaattaattgataaacgtaatgagcgtattcagctactggatgactttaacgatctctatctggtgcgccttggcccgttgatgaagcaaatccttaacctgcgtaggcagctggcagaaagcactttacgtaaagccgaagcagaagcccgacgcagagaacgcgactatcgcaattgccaacaatatatttctcaagcgatagacgaacttatctcgttaaaacagcggtggttggctctcccttctatttccaatgacactattgagatacgaaaccgaattcagcaacagacagaattgattaccgcattactggctgaaattaaagaattggaaaatagcttttgcacacggaataccgagtcaacacgcaaagcccgtgaagaagcaaaagagaaatacgaacgttatcaagaacagcagactgatgcagaacaacgacttgataatgataggaaactctcttctgagcaacgccagaatctcaaacggttgtggcggcaagccagccggctttgccatcccgatctcgtggctgatgcgtttaaagaaaaagcccatcaattgatggttcaactcaatcaagcccgccaacgaggtgacttccccgctattcacgcgttgctgaagagtttaaagcaagggcttgagccactgatggccagcgatcttatcgatgatcttgaacggttacgcagaaaaatcagcgatgtgcggacacaaattgacgcgatattacacgagatcgacgcgctgaaaggagaagagtcatggcggcttgccacctctttgcctgacaaagataaatggttcaaagaacaagaaaatgtcttatccaagacacttaacattcttgagcggcaagtcgaggaagcatcaagagtgctctatgaagcataacgctatgaaacatagttcgctgaaacatagttcgctgaagcataattctatgaaacataatattgtcttaaagcgtaaaaaacccgcgcatggactggccccataaagttggacagttcatacccgggcttgtcaggaaagatggagccagttactgactcaataacgctttcacatccagtaagataaattcattatcgtccgcctcattaggctggcggctggaggagaatgggaagttattatcgttaccgacaatgatatgactggcatccactacatcaacattctcaatggtaaagaacgggaatgtcagtacgccgttgtttaaaggtttacgtgccaagttctgcgggtctttaatattgagcaaatcaatatatgacactttttctactggtttgccgacattgtcatcagagaaagctattttgtagacacgtttaaacttagctatctggctaaagcacttatccgttggcgcccctgccgcacaggctttatctgccgtgccctcgccgttgtcgcgttcaatgactaatccatggtttgcatcaatcagattaaaatcgccaatggcattctggttatcttccaacacatattgccaactgcgccctgtccatgcctgatttttaacatcaaactccaacactctcaggtagcgtttgccatcgatattctcaaatttttcaccatcccacagcgccccttctaacatggggtacaacttgctgccatcgggcgaaaccgccatcccttcaaatccttttgagcgcgctacctgaaaattctgtttaccatcaggagcacccggcagtgtaagcgtcggattatcgggtgatttcacgacgttgccatcaacctgagtctcaaataccgccagcacttttccgttcaaatcggctttaatcaaataaggcccgaattcatcaccaatccaaagggcatcatcggcaaactggaagctttcgggatcaaaatcactgccggtcagataacgtttttcagtactttcattaatgatatgaaacggcacttttttatctggatcgtgcagaaacacggtttgcagtggggtcacattgccatttttgaaatcaatattatagtgattgagataaagcatggcatcaggtgagttagctttgctgccaaatccattatcggttagcacccaataagtcccatctggcatatgctttattcccgagtgcccttgtagcggttggccgttaatcggtaatccaatgcccgtcagacggtcggcagatttagcggccacagaacccaatgcgctaacgcgttggccgctggtatattttccgctttgttgtaaatcagttggagcatcagaaggtgttgcaaccgtcgatttcaccggcagaaccgcatgtccggccagaaccgcgggtacctcaacggcttgtgcccacgacgaagtactgaatgcgatgctactggccagcagcaccaaccggaatttgctcatgtgcatgttaagttccctaattatgtctattgcccaaaggtaaaaagcaacttcactataaggaaccggagtgacagaaatattatccctgttattctttatgattgatgtataaccactatgaatattatttagctcatatagccaaaataacttgagttgcaggaaggcggcacccgagagaccaatcgtcaggaaccgatttgaacgcagcttgaagtatgacgagtctattcattctcaaataaggtaatccatgatgaaagataacgaataccaaccgccgaaaatctggacggaaaacaatgccagcggcggtgtgtggtctaaaatcaatcgtccgacagcgggtgcccgatatgaagctgacctgcccgtaggtaaacacccgttgcagctctattccatgggtacaccgaatggccaaaaggtgactattctgctggaagagttgctggcgttgggggagaaaggcgcagaatatgatgcccatttgattcgtatcagtgaaggcgagcagttctcaagtggctttgttagcatcaatcccaattcaaagattccggccctgatggactattcatccaccccaccggtaagggtttttgagtctggtgccattctgctttatttggccgataaattcggtcatttcttaccaaaatctcatgcagcaagaactgaagcactcaactggctgttctggctacaaggtgcagccccttatttgggtggcggttttgggcatttttatcactatgcgccagtgaagattgaatacgctatcgaccgtttcaccatggaagccaagcgccagctcgatttactcaacactcagctcaaaacacataagtatatcgcgggtgatgagtacactattgcggatatcgctatctggccgtggtacggcagcttggtgcttggcttgcaatatgaagcgggtgaattcctggatgtgaaatcctatactcacctgattcgttggacagagaccatcgcgaaacgccctgcggtgcaacgtggtcgcatcgttaaccgtacttggggtgcgccagaagagcaattacctgagcgccatgatgcagcagattttgacccactcataaagtaagtttacttagctaataaaagatctgacttgataaaaaaacaccgcgcggccataccgttgcggtgtttctctttcacgcgggctatcatgagtattgattattgctgcttacgtaacgccatcccgacatctccaccgggatgaaccgccaataaagtctctttactaaaaccagtacgcgccattagacaggcacagatagcatcaaacagcgccagtactaaaacaatcgatgttgtcgctaacatattcagcggatcgatctcctgctttacatgtgtcttcagcaccaacgcggagacctgcgcaattgcagactgttcattttctgtcacgctgataatcttcacttgcttacgttgcaaggtgggcagcaaacgggttaactcatcagaattaccgccacgggaaatcaaaataatgatgtcctgcgcgccgagaaaccccagatcaccgtgtgccgcatcagttgcattcaggtaaatcgccggttgctcaacacaagctagcatatgcgccactttacgggccgcaatacccgatgtccccacccccgtcaccgcaatttttccacggcattcagccaaggcatccagtacctgcaaccacacctgttgatcgacattctcttttaatgccgccagttcgcggctgtagatcatccaggcatcactggccgccagccactccttattctggctcatgcgccctcctgcatcagtgcctgatagcgcatatggtcgtgatacatctgatggaatacccggtacttacgatcgtaataggctttgattttattggtttgtggggtcacggtcttaccgatgcggctcatggccgccattgcttccggcaatgactcaaacaccccagcagcgacggtacccatcatggcactccccaacaacatcgcctcactctcttctggcaacagcatggcgcagcccgtcgcattcgcatgttcctgtacaaatatggggttcttggtgcctccgccgctggccatcatagtgtcgatgttatagccattctgattcatggtttcgataatatgccgtgtgcccaacgccagcgcctgaatggttgccaaataacgcagcgccatatcttctggcgtggtagagagtttcaggccagtaataatgcccgtcagatttgggttggcacggggagagcggttaccgtggaagtacggcaacatatgaatatcattcgtcaggaacgcgatattttcaggttcacccgccatctgacgcaaaatataattcagcgcctcatagatggtttcgcccttatttttagcctgttccagcagtgccggatagcaaggatgtgattgaataatatggtcaatcaaagcccccgttgccgactgcccgccctcgttcagccaatattccggtaaaatggccgaataatatggcccccaaataccgctgataaaatgtgctgaacgcgacatcgccatatgggcggtagaggtgccaccaatcagcgcaatccgccgatcaaagttagcattttcccccgtcacaccactggcaccgagaatgccaatcgtcccagcgtgagcatcaataatcgacacactgaccgccgtaccggggatcaaccccatttctgatgctgcccgctgacttaaaccatgtcctaacggtgcccccatgggtttaaccgtcgcaccgatcttcgccgcgttgttatccagtaaatcggccagccccaccaatttgaagtaggacggatcccagcgatcttcatggcccagataggtccatttgcagacggtggaacagagcgaacgggtttcatctttcgtggcacgccaggtaagaaaatctggtagatcaaacagatggccgacattactccacgtgttcggcatatgttgctttaaccacaacaactttggtgtctgcatttctggcgaaatcacaccaccgacaaactccaggaccgggtgcttggtggcattaatccgctccgcctgagtgatcgcccggtggtccatccaaacaatcacattttgctcattgcgccctgaagggctaaccgtcagtggattcccttctttatccagcaccaccagcgagcaagtcgcatcaaaacccagccctttgacctgaatcgggttgatatcggcctgattaaccgcatcacgcaccgcattacacaccgcttgccaaatattctcggaagactgctcaacaaaatcagccttgggtttaaacatggtgatttcacggctggcctgcccaaccatacggccctgcaaatcgaataccccagctcttgcactgccggtccctacgtctacgccgataaagtaacttgccattgttttgtccctcaattcttaggctttacgattctgtaatgcgataaagaggatcagtaccccaccccataacgccatggtcaggtagctactcacccccagcaaattcaggccactttccagtaattgcagtaccaccagcgccaggatcagaccgataattcgcccaaagccaccatctggattaatcccgcccagtaccgaggccaaaatggtgaccaacagataggattcgccataaccggctttggcagagttgaattttgccatcatcaaaatggccgccccccaccccagtaaagccgataagatatagaccgcgatttgtacccgatgggtatttacgccactaaagcgggttgcctgttcattggaaccgaccagatagatactgcgccccagcgtggtgtgctccagtaagacccacagacccgcagcgaccagtaggaataagatcatcgccactggaataccggcaatatcgccgctgccaatgtactgaatgaccggcgggaaaccggaaatcacatcaccattggagagcaaaatattcaggccagtaatcagtgtcatggtgcccaacgttgccagaatcggcgacacgccaatgactgagatcaacaccccgttcaaggtaccaatcgccacggcgaccagtaacccagccactaacgccagcagcagaaacgcgggttgacccggatggctgacaatgatcgccgccatcactagcgagcacgcattagcaccggcaatgatagataagttaatccccccggtgagcatggtcagccccatgcccaacgctaacatgcctaaaatcggcaattgcgaggacatcgactggaaattgcctaagctgaaaaagcgttgccccagagtcagtgagaagaccaacatcaccgcaatcagaatcaataattgcaggcggataatacggtcatcagggataattcggtttaaccaggtcatctcagtgctccctcaacaacttgcgtttttcattccacgcggtggtactgatacttaccaaaataatcacgccactgaaaacggtatgccaataagaagagacactcagcagcgttaagccgttttgcagaaaagccaataacatgacacccagcaccgttccggtcagtgatccgcgtccaccgctcatactggtgccaccaaggaccaccgcagccaataccgttaactcaaatcccatcaaagagttaggtgcgactgattgggaaatctgagcctgtactaccgctgccacgcctgccaatatgcccatgtagccgtagacatacaggtgcaaccgaaagatgttaatgccaagacgagaggcggcatctttattgctgcccatggcaaaaatctgccgccctaaccgggtgtaattcatcatgacaccggtgaagatgatggtgcccgccagacataacagcggcagtgtcaggccgtagtcgtaaccgtcactgccttcaaatgagaaccagttaataccggtcataaaccagtctgggaagccgtacaaccaagtcccgttggtaaagtaaaccagcagcccatagaacagattcagcgtggcgatggtgataatgatcgccgggactttcagccaataaaccagtaatccgttgatcagccccagcaacaggccaaccgccattgccatgaccaatgccagcgtgaagctgccaccctgtgtaatcacccacgatgccatcacatactgcgcgatagccgtgaccgccgggaaagagatatcaatgccaccagcaatcagcaccacaaatagaccgcaggctaaaatccccaaaatggcataactggtcgccacatcggttaaattccccaatgtcaggaactcagggctttgcacactcaacccgatagccaacagcaacaccagcaacccgagataaaactcatggtgccccgtgagttggcgcagttttagcttatccattgaccacctcggcgatctgttgttcggtacactgatgaggataaaactcggcgatcaattcgcctttacgcatcaccagcacccggtggctgttgtaatacgcctctgggatctcatcgcaaatcatcaataccgccatcccttgctctgccaatgccttggcaatatggtaaatcccttctttgttggcgatatcgacaccgacggtaggcgaatcaaggatcaaaatacgcggttgtgtcgcgacccatttggcaatagcaatgcgctgagcattaccgccagacaaggttttcaccggcagcgcggtgtccgagactttgatattcaggtcctgcaccagcttatttaccagtgcggcggccttgctgtgatccagcaagccactgcgggtgtgtaattggtcaaaaactgacacgatagtgttgtcatagatcgactgctccatgatcaacccctgagtcaggcgatcctcagagacataaccgatgccatggcggatcgcatcacggttatgacgaaaacgcaccggctcaccggccacgaatatttcgccgctttcgggttgcgtcataccgaacagactgaggcataactccgttctccctgcccccagcaaaccggtgatagaaacaatttcaccctgatgtaacgtcagatcgatattacggaactgctcaccacggctcagtttcctgatctccagcagcggtgccgctttggccgccaacggcggtaacggacggtaagtgaagcgctggcccgtcattagaaacgccagttcatggctgtctaactcgctggcttgccaggtcccgacccatttgccatcgcgcatcacgctgatccgatcggccacttccatcacttcatccagacggtggctgacaaacaccacacaaatgccttgtgatttcaggtcacggaccacattcaacaagcctttgacttcctggctggtgagtgaggctgttggctcatccataatcaccaagcgggcatcggcggcgatagcacggcaaattgccactaattggcggtcagcaatagagagctgttcaacttttttatccagatccagcgtcaccccgacgcgctgcatcgccgccagcgcccgttcacgcatacttttacgttttacccaaaaatctccgccgggcagataacggtggacggcaatattttctgctacggttaaattcgggaatagcgacagatcttgataaatcacctgcacgccataatagaatgagagttgcggcgtaagctgatgaagcagcttgccgtctatcaggatacttgcgcctttctctggctgataaactcctgaaatcactttgataatggtgcttttgccgcagccattttggcctgccagacagtgcacttctcctttgttcaacgtgagattcaccccatccagcgctaatacgccagggaatcgcttgctgatattttcaagagtgataaatgcggtggcctgagtcatgacaataccttccctaacgtcataaatttgacgttatgttctacagccataaggtgatagtggagaagacagtggggttattttcccactgcctgtttacgggtaacttactgcattactgacagcttactgtactgataacgaatctcttactgctggccacgatgaatctgcggccaattccctggtgtggcacctgaaaatcagaagcctaacgttttggcattatctttggtgacctcgaggatcttgttaaaacggatcaccccgttcttactgtccacatcggctttacccaagccatcgatggtcaaatcttctgtcactttctggccattcaacaattgattggcaatttctactaccgcaaaaccggcatcctttggatcccacagcaaggcttttttgatatcgccacgcatcagatacggcgcggcctgtgctggcatcgcaatacccactaccgcaatttggtccttagcccgtttcttggcaaccgcctgacctgcaccaattggccccagtgaaccgaaaccaataatccctttcatttgcggatatgttttcatcagatccagcgtggtggagtaagacttatcaatattctctgccaccggtaaacgtggcgtgacttcaaacatttctgggtatttttctttctgatatttgatagcgtaatcagcccaagcgttatgtaacggcaccgtcagggaacccacataaatggcatagccacctttattacccatggcttttgccagctcatccatattggcttgagcatatttttcgctatcgatagtttcgacgtcccactgcccgatacgttgatctggggattcatgcgtcagcaccacaatgcctttttcctgtgctttcttcagcacgggctccaacactttggcatcgttcggcaccacaataatggcatcgacatttttcgcgataagatcttcaatcactttaacttgttgcgcagggtccggtgtcgctggcccgacttgataggcattgacattcagcttcttcgcggcttcatttaccccgacttccatgcgggtaaaccaggggataccggtcactttcgctacaacggcaatctcatgttttttctctgctgccagggtttgtgtggtgaacagcatgcatgcagaaacgatacatacattcagtaatgcgagattaaatttcatagcaataccttcttgttttctttcaggtaacggaacggttgcaaggtaagaaatcttattatgttgcaaagtgattgttttattttcacgtcactatcattcacagaccaaaggttaacaaaaaaacacaagaggctgctcggcggaccagagtgaaatgtgatgtaagcccattaaagttaatttaaatgatttatttggttaaaaattggttaataaaattgatttaagaataaatacgatcaaataaataggataaacaaccagaaaattaaccatttcaaaacaaaatagatacaaacataattttatgcttgccatgtagcacgttaatcgcacccaaaagagtgtcatcgatataatcatgaggcgaaattgagatatacctctcattttcgaatggcgatccacctctgttcaccttttttagatgaaactttcacacaattgcttccacagcatcatcgttttcagacaaatgagtgtcagggccatatgcagataaattatgcagataaataacgcgggtttgcgtcaagagaccgcgggctaggcagactacgttgatcttttcctttcattcatcatggatatggtataatcagcgcaaagccgccctcgctgacaagtcacctgccttttgtgccaatcactacgcgaatccccgcttttactgtaaaaattgcgtcaattttcgtcctcacgaaaacgatgattgaccactggtgtcagaagatatgtatcgctatcgagttatgtccttatgcgttacacactcgcacttaacgcataacgatagagttcatatgataaagccgcagaaattccatatttccctgctacacccacgctattggctaacctggtttggccttggcgtactgtttttgttagttcaactcccttacccactactcaataagttaggtgtttggttggggcgaacctccatgcggttcctcaaacggcgggtttccattgcccgacgtaatcttgaactctgttttcctgacatggataaacaagtccttgagcagactatcatcggtaatttcgaatcattgggcatgggattgctggaaaccgggatggcgtggttttggtccgatacccggatacagcgctggttttccgtctccggtctggagaacctgaaacgcgcacaacaaggtaaacggggcgtactggtcattggcgtccattttatgtcattggagctgggtggccgggtcatggggcaatgtcagccaatgatggcgatgtatcgcccacacaacaataaagtgatggaattagtgcagacctggggccgtatgcgctccaacaaagcgatgttggatcgtagagacctgcgcggtatggtgcgagccttgaagcagggtgaagcggtatggtttgcaccagatcaagattatggcccgcgcggcagcgtttttgcaccactgttcgccgtagaacatgcggcaaccaccagcggcacctttatgctcgcccgtttagcaaaacccgcactgctgcccttggttttattgcgcaaaaaagagggccgtggctatgacctgctgatccaacccgcgctggaagactacccgattgacgatgagatagccgctgccagctatatgaataaagtgattgagaaagagatcatgcgcgcgccggaacaatatctttggttacaccgccgctttaaaacccggcccattggcgaaccttcgctgtattaatttcacttatttatgtgaaaaatcagacggctgacaaagtcaaatgaaggggaagcgtgctgttggggtcgtaggaatcacagcccatttcattctgtggtttaatcgctcaaatgttgcattgataccgttttttgaaggaccaagcataatgaaatcgttaatactcctcttagcattactgatacccgccagtgtaacggcaaataccctctcggttgagcctaaggataccaaaccagccctgatcgattcgttatcagccacttttgcgattgataaaatcgcgatgttaaaaaaggaaaaaggcgcaaatgaatccaatctgtacctgccttttgaacaaacaaaagacggtttggcgatcttatttggtgatatcaatcaagatggtaaaatcgacgcgttagtcccctttacctgggaaggcctcaatggtcttgaccaagaaataccctctaacgactggtacagctattacgccatttatcttcaggatgaccaaggctggaaacaggtagggcaaatcccgacaggcacctttaccacggataatcagacgctattaaccggcattgaggacggggtcatttacggggagatcatgccacgtatgacggatgatgacccacaacctcaacagtgggtattacgtgcgcatccagaaaaagacaatcttcttgttccgatcccaacaccgcagccactcgctaacgccctgacccttaatctgagcaaaaagcggccattaacgcgaaatgcgttagtcaccgcctttggtgaacccatcaatattggtgacaattatttcttagtagacggagattgtgttgggcacccagactggaaatattaccaataccccggagccgcttttaatgtcagccaggatgataacagtgttggagtcagtcactttattggcattcctgacaacctgagtttagtgctgggtgatcttactatcactcagaaaacctctgcacatcaattaattaaagcattatctcaaaatgacagttttaccgtttcccgtaccagcaccgatttgcgaacagatctggggcaatcatcaccttactttgacgatgcaaacgatattttcgctctgcgcctgccttactacatcgctggatttgaggcttgggcaaagaaaaatgaagccagagaagtacccaatgatgaagaagcagacacattcacccgacaattttatttcaccacgacaattggtgtggccccaattcagaacagtccaacacggctgatgttttatttcttaggggacaaaatggtagcactcagtgttatttatgatgacggtcaggtttgtatctaaacagcccaaacaggcacgcttacggacataactcagcattttcttttttcggggttatgtctgttaggccataatcaccccccccccctctaataagcccgcttttgttaccctctgataagcacagggctgtcagacggctgacaaaccccaatgagtcgattacgttttaagtctcatgtaatcggtaaacggggccaaatagccccgtccgtaagatattaaccttctttttcgatcagcaacgcttccagcaaatccaaatcatgcagcagcttttgcagggtttcattgctgattttctgcgtggcgcgcaggtgatataactcaccacgttcggcccgcagggcggttaagcgaaaacgccgttccagattttcaatcagcagcgtattctcaacttcatctttactgcccgtgcgccgccgcaatgtaccaatgacccgcgagctaacctccttcagtaactctgagtcaatattctcctcactactggtcattagccgctcttccatcttattcaggctaacaatcgcgacttctgccatcgccgcccgagccagacgaatttcttcacggctggcactcttatccgcaaccaccaccccgcgtaataacggcggcaaggcgatcaccccaataatcaccgacaacaagatcacgccagtggcgataaagaccaattggtagcgggatgggaaggctgagccatcgctaaggaataagggaatcgacagcacaccggcaagggttatcgccccacgcaccccggcgaatgaagcaacccacagctcacgggtggtgtaatcgctaaattgcagtggccgcttggtcagcacccgcttactgattttcttcatcgaccacaaccaaccgaaacgcagcaacaacaacgcgccataaataatggcaacatcagcgaacaggttccaggtttgaatggtcgggtccagttctgcttgtgtgatggaggtttccaggatccccggtaattgcagacccaacaggataaataccatgccgttaaacacaaactccaacatcgaccacacactgtcagcacgcagccgcatcgccaacggggcattacgaataatacccgactggctgatggtcatccccgccgccaccgccgccaagatgccggagacgccaaggtgctctgcaaccaaataggaggcgaacggtaacaacagcaacaagacaatttgtgtcgctggatcatcgccgctccagcggctcataatacgcagcgatttactgtacaaccaggttatcgccacacccgccagcagaccaccgatcgcgacttttaagaactccagcgtggcaccggaaacggtaaagatcatcgtccccatcgccactgcaatggcaaatttcagcgccaccagaccggaggcatcgttcatcaacgcctctccttccagtacgcccataatggatttcgggatccgccctttacccacgataccggatagcgctacggcatcggtcggcgataacaccgccgccaacgcaaaggccgccaccagcggaatacccggtaccatccagtaaatcagataaccgatacccacgatggtcaccaaaactaatgccagtgccagacccaatatttctcgcccatgatgaataaattcccgtgtcggtgttttccaaccatcggcaaatagcagcggcggaatgaacagcaccaggaatagctctgggtcaaaattgacatgcaacccaaaattgggccaagccagcaaagcaccgcagacaatttgcatcagaggaagagggacttgaaacggtaacattcgagtgacaacgccagaaagcgataccactaaaatcaaaatgaggattgtaaaaaagatttccatgctttccttaagactccacacgacataattttgtgatcatacccgcccgaagccaaggccgggcatcgctttcgatagtagatcacttttttgtgaagcgggggaaaaacctgtgacaacccgtagaaaaaataaagaaagtagggatatataacattaagttcacatcggggaggataatcccccccgatgcctgcaaccaattgttattacaagcagttactattgcggaaagtcactattaaaaatagtcataatctcgaatggccatgatgacaagtatccaccattacaagtatctaccattacaaacatccaccattacaaacatccaccattacaaacattcgcaatccctgtgggcttaaattgcccaaccacctgcgtagaatgcaaccagtgcaaccgcaataatcaccgtaccgacgttcagtttgcgccattcaccagagcaaacccggccaataaccagtgagctaaagcccaacataataccggtgacgatattgcaggtcagtacgataaataccgcacacagtaggccggacatggcatcaacaaagtcctcgaaatccagtttggatacattgcttagcatcagcaagccaacatacatcagcgccggagcggtggcataagccggaaccaaatacgacagcggcgagaggaacaaaatcaacaggaacaggataccgaccaccgtcgccgtcaaaccagttttgccgcccgctgcagtgccagcagccgattcaatataaaccgccgccggtgccgcccccaccaaacccgcaaaaatgctactgacggagtcagtggtcagcgctttaccaccgctgatgatttggccgtctttatccaacaagttagcctgccccgcaaccgcgcggatagtcccggtcgcatcaaataccgcggtcatcactaacgccagtacgcttggcaataccacgggttgtaaagcgcccatgatatcaaggctgaaaatcaaagagtcgccgttagcatccgccagacttggcatcgcgaacagaccctgataggtcacgcttggatcaaaaatcaggccgatcaccgagatggcgataatcaccagtaaaatcccccccggcactcgcagtttctccagaccaaaaatcacggccagacccagcaaggtcattatcaccgggaaagaggtaaatgcccccaacgcgaccggtaaaccttcaatcgggtttttgataaccaagccgacaccgtttgcggcaatcaacagcaagaacagaccaataccgatgcccgtaccgtgcgcaacccccattggcaagttacgcaggatccacgaacggataccggttactgagataatggtaaacagcacccccatcaggaagaccgcacccaatgccactgggatactgatttgctggcccaataccagactgaacgcggtaaatgctgtcagtgagatggcacaaccgatagccattggcaggttagcccacagacccatcaacagagaaccgagacccgcaaccaggcaggtcgcgacaaacaccgccgtcggtgggaaaccggctttgcctagcatactcggtaccacaatcaccgaataaaccatcgccagaaaagtcgtcagaccggccagcacttcttggcgtacattactgccacgttcactaagcttaaagaatgcatcaagcgtgccctttggctgtgcttgagggttgctgctagacatggtgatgtcccctgtgtgtcattttaaaatagcatgccaagccaagcgcccttccctacgtaatcgtttccgttcctgtcgatgaactcactaactctccctgactcatagagcggggaaaaatagcaaacgattagctgggagaacgcatgactgaaaaaaaatcgaagtttagggcagatgtcatttaaggcaaacgattatctagccatcagtggtgactaatcaacacccgaatgcgacatttaatacattttcttcaattaatttgtcgggacgcattaatttgatgagaaactttagatcatcaaatgaataggttcatcgaataaacatcgctcaaacaccttattgtagctacatcgtagctacaataagggtaatttaatggaggttattatgactgatactgttgttcgtgcccgagttttcaccggcctcaaaagccgctgcaatggctaatgccaaagcccttggcctcgatttgtctacggtgatccgtatggtcgttaatcgccttgccgttaacgcagaactacccattgatttactgcaacctaatcaggaaacgttacaggctattcgagatctcgaaaacggggtggaggtttaccgtgttgactcggtggatgcgctcaaacgtgatcttggttggtaacaatgctgacaattgtctatcagagccgctttaaaaaagatgcaaagcgttacaccaagaataaaaaggcgcagaaacagactgctgacaaaccccgatgacgcgatcttgaacggtgaggataggcagaggagtaaagcgtccgcgccaaggatggcgcggctcgagcctacatggatgtatttacggcgtctttacgatctgcctgttctctccgtcgcgggcacgttgtcaataacctcagaaagttattttagaaaccatttcactgttacagacaggtgaagcgttacccccaaaatataaagagcatccattaatcggtaactatattggttatcttgaatgccatggcatgccagatttattgttaatttatcaacgtaccgactcagaaattaaactctaccgtgtaggaagtcattctgatttattttaaatgaaactgaagtgactaagactgaagtgactaaaagagagtcagtctccccgccaaatcccccccatttctagtggtctggaacagtgcaggaaactgactgggaaggttatggatggtttgttcaaatatccattttggtattttcccattgcgctcagggccctatttgagccgtctcaattcgccacccgtcgtgatgttgctgtaccttggcgtgacgctttaatgccttggcgtgatgcctcaatgccttgggggggggacaagactctttccaacacctcggcctccagcgcggccagcttcgccgatcctttgcgacgtgggcgcggcaaatcgatagccagatccaacccaatacgcccctcctcaatcagcagcacgcgatccgccagtgcgatagcttcactcacgtcatgcgtcaccaacaatacagtgaaaccatgctgttgccagagacgttcaatcaggccctgcatctcaatacgggtcaacgcatccaacgcgcccagcggttcatccaacaacaataaacgggggcgatggatcagcgcccgcgccagtgcaacacgttgcttttgcccgcctgataatgccgcgggccattcattggcgcgatctgccagcccgacggtgtccaatacctgcaacgcgtcatcacgccagtggccacgcaagcccagccccacgttatcaatcacctttttccacgggagcaaacgagcctcctgaaacatcagacgagtctcatccttggcatgactgagcagcgcattaccactcagcagtgttccgtcactggccgcttccaaccccgcgagcaaacgtaacaacgtactttttccacagccgctgcggccaaccactgccacaaattgtcctgcggtgatacgcagttgcagattatctaaaacagtacgattaccataacgtttgccgatcgactccaacgttattggcgtcccttgcgggatatgagtcagtgtggtcattgcgcttctcctgatttctgttgataggccggatgccaacgcaaccagactcgctcgagcagttgtgcactgccatcggccagtttgccgagtaaggcatacagaacaatggccaccaccaccacatcggtctggagaaattcacgggcgttcattgccagataaccaatacccgaattggcggaaatggtttcagccacgataagcgtcagccacataaatccgagcgcaaaacgcacaccgaccatgatcgatggcaacgcgcctggcagcaccacttgcgtcaataatcgaaaaccgctcagcccataactgcgcgccatttccagtaggccactgtcaatattcttaataccgtgataggtgttcagataaatagggaacaacgtcccgagtgccaccagaaaaattttggcggattcgtcaatgccgaaccacaggatcaccagcgggatcagtgccagatgcgggacattccggatcatctggaccgagctattgagtaaccgctctccccagcgagacaaccccgtgatgacccccaacactaatccgatgctgccaccgatgctaaaaccaatcagggcacgccaactgctgatagtcaggtgttgccacagctcaccacttttggtcagtgcccaaaatgcggtcactacggcacttggcgcaggtaatatgcggttggataaccaacccgcctcaaccgcgacttgccagccaaccaccaacgccacgggcaaaatccaaggggccagccgatgcagaattcgttgtgcactgattgtcatcatgtttctcctcagctttgcgagactttttgtggcacataaatattggcgactacttcaccttgcggttgggttgcaggccgctgcgtcggtagctcggtggtagccaaatcaagatgtgggaacaacaattcactcacacgataagcttcttcaaggtgcggataaccggagaaaacaaaggtatcaatccccaggtcagcatattcctggatccgttgtgcgacagtcgggccatcgcctaccaatgcggtacccgccccgcccctcaccagcccaacaccggcccacagattcgggctgatttccaaattatctttcttaccgccgtgcagtgcagccatgcgctgctgaccaacagaatcgaaacgagcgaaagcctgctgcgcatcggcaatggttttatcatccagattagctatcaaacggttggctgcgcgccaagcctcttcggtcgtttcacggacgatgacatgcaagcggatgccgaaacgtactgtgcgcccttttgccgctgctttagcccgcacctcctcaattttttccttcacctgttcgggggtttctccccaagtcagatacagctcaacctgttcagcggccaaatcttgagctgctgccgaggagccgccaaaatacagtggaggccgtggatgttgaaccggcggaaataacagcttggcgccttttacctgaatatgcttgccagcaaaatcaacggtttcaccttccagcaccttgcgccacacatgagtaaattcggcagaagcctcgtagcgctcagtgtgattaaggtgtaatccttctgcggccaactcttctggatcaccaccggtgaccagattaaacagcgcccggccattagaaagccgatccaacgtagcggcctgcctggcggccagcgtgggggagatgatgccagggcgcagcgcgaccagaaatttcagccgttgggtaacggggatcagcgaggcggcaactaaccaggaatcctcacaagaacggcccgttgggatcaacacaccaccgaacccaagccggtcagccgcttgggcaatttgctgtagataactataatcgaccgcgcgtgccccttcagaactgcccagatagtggccatcgccatgggtaggtaaaaaccagaatacgttaatgctcatagcaggctctccttatcattatttggtctgtgattttgctgtagatgattgctctatagatgtctgcgctatagacggttgatctgtaggtaattggcttggagatgattggtttgaagatgatggctttgaggataattgcccggctggctgccaaacacgttgcgaaatatccactttgaccggtaacagccggttggcgaaaaacagatcggccgttctttgttgggcagcaaccgtcgcctgactcaaaggctggatagccgtggggggacgatgatccagatagctggcaatcacggcctctggtagccccatcgcgttggccagtagcgtgatactttgtgctcgatcgctaagcgtcaacgcatcagcctgcgtcagcacctccagcacctgctgaataaatgggccgttagcttcggtataaggacgagaagccagatagaaagagcctgtctggtttaattggctgccatctatcagtacccgtatgcccccttgcaacaaggcggcggaatagtagggatcccaaatgacccaagcatcaacattgccctgttggaaagccgctcgtgcatcagcaggcgtgaggtagacaggttggatatcggtaaattttagccccgctttttgcagtgcctgcaagagcaggttgtgtgagcttgaacctttctggaaagccactttatggcctttcagttcagcaacgctgttaatcgcgctgttttccggcaccaaaatcacttctgccttcggtttcggcggctccatgccgacatacagcagatcagcgccagcagcctgagcaaaaatggggggaatatcgccagtactgcccaaatcgatgctgttgacgttcaacgcttcgagcatttgcgggcctgccgggaattcaatccagctaatttgggtatcaggaaagcgtttttccagcaattggtgagttttcgccaacaccagattcaccgagcctttttggtacccaatgcggaactgggccggggcgctatcctgtgcaatcactgtattagtaaacgctaacgtaataatagcggccattgccccgatattgagccagcggtgaacgttgaacccacgacgaaagaagaaagatagcgacataatgatttcctttattaggcagccgtttgctgaaccaacgaagatgacacagcgttagacgccaagggtttacggcgaccgagtgccagatagaagctttccaacgcttcttctaaccgggttgtcgcacttgtagacaccgtgacctgttcaccgtgaaaaaccacctggctgtcatcgacgaaaacgccatgcagcacctcttgggcctttagggccgtcaataccggtttcagcgcatagtccaccgccagcatgtggccgatggaaccgccagtcgccagtggtaggaccaccttatggtccaatgccctctctggtaacagatcgagtaaggttttcagagcgccagaaaaagacgctttataaataggcgtggcaattaacaggccatcggctgttgctagctgtgcaacaaaagcgctgacgtcggggctgttaaaattggcacgcagcagatcatcagcctggaaatcgtgcaaggtgtaggggatcacctccacattctgctgttgtaaccagtgttggcttaaatttaacagtgccgcagagcgtgagggagtccgtggactccccgccaaagagataacgcgcatggttattccttatatcaaaaagttatttttaacagtgatttcacatttaagagttataaaaataacaacgaaaacgcatatttctaaatatcatttttgattttgatatgactggatgattggataaatgcaggttatcaatatcgtcgccaatggatcttacgatgccgttctctgtcgctatggggcctgtcttcgtcattcggccccatcggcagggcagaatacgggtaatttcttgagccagatcacaactttattgacctgaaaattctatccatgttgcggggaatcctgcctatcacgctttacgccacacttgcctaaagtaagcccatgtctaccgcatagtgaccgatgcatagctacatacacagctacctatacgtagtgacatacatatagctacatacacgtagtgacatacacatcgctacatgcgcttatttagcaaacaggagtataagtaaatgattgatttcaatgatccccgccaggttgcgaaggctattcagttcaccaacgtcaatgccgatttaactcgggaaggggtgattaagcacttaaacatttgcctggagtatcaattcgatgccgccatgatcgctccttgctgggtctctctggctaaagacgtgctgaaaggtagcggtgtacgagtggcaacaaccgtcaacttcccacaagccaatgacaccaccgcgatgaaagtcgccatcgtgagagagcttgcgaaagaaggtgccgacgagttcgacttcccaccaaacccaggctttttactgggtgggctggatgaactctattttaacgaactgaaagaagtcacccatatcgcccatgatctgggaatgaaagtaaaggcgatgctggaattcggttttattaccgaggaagccatgaaaatcaaagccacacgttatgcatacgaagcgggaattgattgggtgaaacaatctagtggctggggtaaaggcggatgcgcagcaacagtagaagatgttcaacttctcaaagccaatattcaagcgccttgccgtgtcaaagtttcaggtaaagtcaatacgttagagaagatgaaagagatgttccttgccggtgccgagctggttggtactagctccggccctgaactggtgaaaggactaactggcgacattaacgcttattaatcactgagtaccgccgtagacactttgtcagtaaccgcagtatcgccgtaaacgggggtactgctgctagacaaatgaataacaaatagactatgcaaatgaataacaaacagacttcgcaaattaataacaaacaaactatgcaatgaataacaaacagcacagttaaaggagtatgtgatgagtgtatttattctcggcagctatgcgaaagcgctggtgatgaccaccgaccgtattcctctggctggggaaacgctgattggctatgactttcgccagacgtggggcggtaaaggctcggatatggcggttcaggcagtgcgtctgggggcagaggtcgcctatgcgggtgtcgtcggtgatgacacctttggccatgaatttgtcggcttgatgcaggaagaaggcgtcaatatcgacgcattaaccatcagcggagaattaccaacgggggcgggacttatcgttaaagataaagaagcccgtaacgtgattgtcgtggatatgggggccaataaactgtttaccccagcgttggtggacagcgccttatcccagctcaaacaaagcaatgtggtgctcgcacagcttgaaattccgctggaaacggcactttacggactccaacgggcaaaagaattcggcaaaataaccatcctgaacccggctccggcaagggatctgcgcggtctcgatctcagcgcgattgattatttgacccctaatgaaacggaagcccgcgtggctctgggtctgcctccggatgacccacgcagtaaccgagagattgccaacctcttactggaaaccggttgccaatatgtcgtgatgacgctgggtgaatcaggttctgcggtgtttggtcgcaacgacacacaagaaatccccccctgcatcattgatgtcgtcgacagtaacggtgcaggtgacagctttaacgcggcactggccgtcgcgctggatgaagggctgccgattagcgaagctgtgctgtttgctaacgccacggcggcgttgtgctgtatggattgggaaacggttccgtcctatcgctaccgcgaagatgtcgatgcttttatgcgatctataaccgtgaaagaggaataacaataatgagacccgatagaatcttacaccctgaacttgccgccgctttagccaccttaggccataccgacattatattggtcacggatgcaggcttcccgatcccgccgcaggctaaacgtatcgatttggggttttggcctggcaccgttgatgtactggatattctgcgcgtcctacgcaaagaaatttttgtggaagaagtccgttttgccagtgaagtccgggattgtcacccgcaactttatcgtgacgtacaaactctctataccggctccggcgctgaatttcaggcagccagtcacgaaacgctctgccacgaccttgcctaccaagccaaagttgttatccgttccggatcatttaatccgtgggccaatttcgcgctggttgccagtaccgatccttttgcctggttcaccgatgaatctggcgtaaaaccgttgcccgcttatgtcgcaagacggcaacgcattctcgacaacgtcgtaccggaactcaacgcctaggggggattgttgtgaaagctgcggttgacggtattggcgcagttgacgatatttataccccaatattctgttgataacacatacggctcctacaacgggaggccgtatgctgctcatctctcataatcctatcgtgcgtggcgacagccaggaaatgactcagtcgtgacggtcattatccaattgccgctcctggcggcgaaaatcacttggggataaaccgactgaccgatgaaaatcacgggaaaaatgcagcgggtcgttataccccacctgcccagcaatacggctgatggtctcctcggtttccactaataaacgacgcgcttgggaaaggcgataatttttaagccatctcaaagggctttgattaaatgtctcctgaaataatcgaaaaagttgcgacttactcacttggcaatactgcataaacttatcaatatcccagtcatcattgtaatggctatgaatctgataaatcagccgacccagcccacgatgggaaatgaccggcgatttcgtggcatcgaaactgcgattctccagcagggtgtatatcagttgggaacacagcacatcgcaatgggcatccgccacgagggtatgactctgcattaaatcaaataggcggtgataaatatcggtgatggtttcaggggaggtgaattcaaaaaccggttgttgggcaacatcaaggatctgcatgatattgttgagtttagcgccatcaatgcgtaaccataaaatctcccagggttcttgtttatttggaaaatgttcatggggccaacggacaggtaaccaagcgagattaccctttttaacttcatgaagattattttccaggcggataaatccactaccattgagacaaaaaatcaattcgtgaccggcaacagactgacggcgtacatgaaaattatcggctgcacgaatatgacccgcacgcagaatccggtagttcaccaacgtcgaaaactcatccgactctcgataccagttcgccacgacctgcgttcgttgcatgtttttttccatacgccccacacgatgttgatgacagaaattcaggctatatcccggttcatcgtgacatgccaagaagataaaaacaggttccccctcatcatactgatgaatttttgaagcggctcacaaatccattgacatgagaattgtgtccataccgcggggagttctgcctataacgtcttatcccacaacggactaaagtaatcacatgtccaccgcggatggataaacgccagaagcaaagatgaccaactggaggcattatggatacattaattagccaattagagcacgcaacccagcctgtactaccgaaacgacgggattaccgcatcgggattattggtgcaggttttatcgttgagcattgccatctggttgcttatcaaaaagcaggcttcgtgccttatggcataacctcaaaggagcatagccagaatcaccggttggctgagacatttgcgataaaaaaagtttatgagacatggcaggatatggtttgcgatccgcagatcgacattatcgatattgccgtcccaccgcatatccaactcgaaattgtgcgctttatttgtgaaagcaattctgcggccaaacatatcaaaggcattctttgtcagaaaccactggcaatgtcgctgaaggatggccgtgagattgtgcgtcttagccaacagagtggtattcccatcgcagttaactccaatatgcgctatgacccttccatgcgggcgcttaaatatattcttgagaatcaactgatcggcgatcctgttatcgccagcatagatatgcgcgctattccagactggcaggcttttttgcaaaaatataaaaagctcgaactgtatgccatggcaatccaccatattgatgctttccggtttttatttggtgacccggtaaaagtaaccgcagtatgtcgtactgatccgcgaaccacctttgaacatattgacgggatcacccaatacactttccagtacgcaaatggtctgatcgcaaccagccttgatgatgtgtgggcatggccgggtgaaccttgcgccaaaaataactacatcaactggcgcgtagagggaagtgacggactggcagaaggtgatttcggctggcatcgtcgggaacctgaatattgcggaagtaccttgaaattggcgtcgcggaatcatcccggacaatggatcgccccaaaatgggaaagacaatggttcccggatgcatttatcggcaccatggcaaatttgatgtgcgctattgaagaaaaccgccccccggaaataagtgcagaagacaatcttggtacgctggcctgtattgaggcttgttatctctctattcagcaagagagaaccgtctatctcaatgaaatactcctggagaatgcaaaatgattaacgttggcatctttaccggttattacccttacaccctgagtggcaccatcgacaaaattaagcaggcgggtatgggatgtgtgcaactcgatcttgagttcaccgacattgatcttcgccgggggcgcattaccaaagaaaaagcgcatcaggtacgtaatgcatttcgtcgggcgaatattcccattgtggctatctcggcgtataccaacttagttcatccggacccggtaaaacgtgcagaaaatattgctgcggtgaaagagatcctcgctcacgctcgtcactttggcacgccatatgtcattagtgaaaccggaacttataatacggacagtgactggctgtacgatcctaaaaatagtactgaagaggcttatcaggaatttaaagctatcgccaaagagttagcgacctttgcctatgagcataatgcggtgttcctcgtggaaaattacgttaataacatcatcggttccgtaggacaggttgcccgattgatgcaagaagttgaacatcccggattaggattagccttggatcccaccaactattttgacgataaaaacatagatgctattgatgaaacactgcacaacatttttaacgtactcgagagcagaataaaaatcgctcatgccaaagactgtaaaaaaacagatgctatcgcagagaaatttggtggaggtgccgcggaacataacagctttagaggggcgggttcagtagaattaccggcagcaggattaggcgcgttgaattatccgttatatgtcgagttgctggcccagaagcatcctaatattccactgattattgaacatgttgatgaagaggatatcccccgagccaaacgctttgttgacgaggttttaatggcaacaggcagttgacctgttttatcacgtagaatttataaaacaaaaaaatgtggctggctaaaccagtcactttgtataactaaaaatattataaagacagggtttacgcccggcacaaaatttaaaatacaaccatatcggaatggcctgataataaccttaatcgccagtgagatcgcaactcaacaggtacttaataagattgaaaacgatcaccatattggcatggactggatacaggataacagcgagatgtatctggcgggagactggctcacacaaacgggcttaactgggtaaccgctggaagtggtaacgccacgcctgatcttccgcgatgatcttgcgcagcgcgtccagccggtagcgggtaaaatcctgcccgtgctggacatctttgaagcgccccggaaaatcaaaatgctcgtagtccggtcgctggttttgcagttctcccgactgttcgctgaaggccacggcccagttcgggtttttaaaggtgtagtctttcagttgcaccatcgccgggcgcacatatcaccgttgaactcacaattgataccggacagtgaagacccccgtaccatcaagcaacaaaaccaacagcagcaagcgcaaccgagtgaaattaagttgaggtttctgaccagaatgatagctacttagctgcctttaaaataagtaagccaaaatctgaaggagttttggcttacttgtcgactttaaagacttttatattctgactcggcattaataatcatgcagccaagttcactatcaaaaggccattgatcaataataattctacttattcctagatttctatgtgatttgtcagggatgttatttagttgaataaggtgctcacaattcattaatttttctttaaaatggttgagctgatttattgttgtgaatgtctgaacctcattaaaattatctatagcttgattaattccatctatagctaattttatttttttcattgcattatctgttttcattgttttgttaacttatccaagttactaatgtatttttgtatctgaccgccaggtaagccaacaccttgagcagcagcctttccttcaatgatggtaacacctggagtgactttaaattgtgaaaaataagtcatttggttccattcggttttaaccgccaaactagatctggttgcaggaaatgtttcaaatatatatcttcctttctccaaagcattaacattatcaaagtaccttagcccatattcattcgatgttgcagggcgtaccttgattgtttctatatcgaaagactggattatttgctttctaaaatcacgaggcacattttgtgatctcagatattctgatgcatctctaacaccttgatatggatgaggaggacatgttgccagccccagcggatccacccagctcaccggattatgtacatacccgtacgggtttaatcccccttccagccctatcgggtccgggcatagatattgccccgtctcgccatcatagtagcggaaccggttgtaatgcaacccggattctgcatccgcgtactgacccgcaaaacgcaggttacagctgacccgatcctcctcattcgccgcctgtcgccataattccgcctgcccccacgtgctcagtcggctcgcccacaccaccttgccctgctcattcaacaactcccgcggcgtacccagatgatccgccaccacataatgcagtttgccttgcgcgtagcgcgccatcggcgttaatccgcccggcgcatacagccagtggatcccctgctcatacgccaccgtgccgtcggcatacaccggcacctcttcgattaactggtcgccgctccacaggtacgcgtaaccggccagtgatgccgtggccggaccggtggaaggagcgtccatctcattgagcggcggggtatccactacccgcagttttcgaatacgtcgcccaaaggcatcataaccgtagcgccagcgcgcccccgtcggcgtgatcaattcggataactggtcctgctcattccagcggtagcgccacagctgtggccggtagccgtctttttggctgcgtttctccaccagtcgcccgccagcatcgtaacggtactgactgtcaccgcgcttcaccacccggcccgcctgctgttgctggctcgcctgcgccaaaaccgcctgtgccccacgcggtaaacagcgatgctcgcgcaggttctggttcacatcgtagctaaactgctcctgcaacggcaaaaaaccaccaaaatcagcgcggacgacctggtcattgcggtcatattggtactgcgttttaccccaacgcccgtcatccatccccaccacgttataagcccggtcatactgccaactgcggttgaccgcactgccgtgcaaggccgggctctccggggcgatcaactgttgctggaataatgccgagttacgcccggccgcctgatgggccaacagcccgctcggggtataattgcaggcctgaataaacccggccgcgctttcacgtaccgtctctcgccccaatcggtcatgctgcaacgccaggggctgatggcccgccagctgtagccgggtcagttcgccctgtgcgccgtacacaaacgtcagccccagctcacccacctgtcgggcaacaggggtgccgtttagcgcatcccactgatgccgcacctcccggccattcagccgctccgcaaccaactgacccgcctcgtcgtaatcaaactccaccaccgcatccgcattggtcgcgctcagtaaacgaccggcacggtcataaccgtagctgaccgtgccaaccagcgtggaactcagtgcatcacagtgccaggtctgctgcgccagcacctgatcctgcatcgagtagtgccagcgaacaaggcgctgatccgggtaacgcgccccgatacgccgccccaccgcatcatactgataatgaaccgtgcgcccggtaaaatcggtttcgctgatcacctgcccggcccgatcacgggtataacgataggtgtcacctgacgcattggtcacctgattcaggcgcgtcagtgtgtcatagccgaaggtcagccgctgcccgtccgggcgtatcaggccggtcagtaaatcaaaaccgccgtattcgtaacgggtggttttccccgcgccatcggtcagcccggcaatacgcttctcgctgtcataggcaatggcctgctccacaccatccggcatgaccatttttgtgacgctgcccgccggactggcatgcgcgtcactgtgtgtgtaacgggtgagctccccgagggcgttttggtgagaaaataaccgccccagcacatccagtgtgacggctgtactgttccccttcggatcgataatggtgcttaaacaaccgtggtgatcatagtggtaacgccacacctgatcttccgcgatgatcttgcgcagcacttctcccttcttgccgtagcgaaacgacatcgtctggccggaaggataagttacctgtcgtaacaatccctgcctgtcatactgatattgccagctatcccccgccgaagacgtaaacgcagtgaccacgccagacgggttatactcatattcggtacgggtttcatccgggtggatcacggcggttaaatcaccgcgctcattgtaaataaaccgggtgatacgccctaatgcatcggtttcttttattttctgggtcaagtcccagtcggtgagggtgatattgcctaacggatcgactaactttatcagcagattgttttcattatagtgataaccggtttctcccccttccccatcgcgatagatcgtatagcgttctttgtcatgataaataaaatggtcggcaaaaaaaccggtcgatgtttttagtgccaccacccgccctgaaatatcataacggacagccacatccgtgctatccgtatcccgccagcgcaccatataccccttcggatcatattcatgcgacagcgtgccatactggaaactctggcactgaacgaggtaaccgcgctcactgaatgtactctgcaacagcttttgtcttttctcctgcgtgacaagctcgaccgcgtgtattgtcctgccacggctgtcgatctccagcacatagccgtcactgtgctcgaccgatatcagttccccctgttggtaacgaaaatcgattcggttccctttgcggtcggtgatagccgataaataacgctgctgctgttgctgttgattaaaatgcagtgtctgctgagttgaccggtcaaaaaccctgagttcgccatgacgctcccccactaactcataacgcaggttatacagattgacggcctggactttattctctggcgtaaagaagctcagcccccccccttcctcgtcaatgtaatcaatgttgtcttcgtgcacgaccaagtgttgtgaccagctatccgcccatttatgaccaaagcaacccgagaccgtgaaataatcgccggaacgataagtacgctgtaaccggacaggcaaaacaccggcaatatcaatcacgggccagacctgaaggtaatcgccggagaccatatcaacaggatcactgccggtcgggcagttatgggtagcgttgaccgcggtattcggcggcttttttaaggagcgaaacccttgctcaaattttttctgtattggcaagaaactcagaataaccgctgaccagcgtaaatacggattacggctgtctgccacttcatacacataagccgtttcctgcgtgatggcgagcgaaccgcatcccgcattgatattgccatcgcaggtggtacggtgccccagacgcgcgatctgcttttggttggcaaacacggtttttgcgccctcggcaatcatcggcggcggtgaactggggtgatcgctgcattggatcttatcccccacccgggccaccggctggccttcaaagaagacgttggcggagccttcagcaatcacgcctttgttatcaccgtattgtcctaatgccgccccggtcgcggcggcgataccgccgattaatccggctgcggccgccgccgcggcaatcaccaccaaccccgtaccaaaggtgacgaccaccaatgccgccgccgctgcccccagtaaaataccgccaatggccccccacaccccccaatcttttttctgatgggcaatgggatggcccaggtgcgcggggctttctccttccgtcgccacttgattaaaattaagcgcacgggcaataccgtgacctaacttattgccgattttggcaccgacatatcccccggccatcccggcggccagcccgacggtaaagggaacggccaccccggcggcaatcgcctgcatcccaaaaccggcggtcaccagagtgttaaactgctgactttccgccacattcagcagagaatcactcgctcgcgcgatattccccacattgggattactgacctgataatccgtccgcgccgggctctgttgccccagcgcggtttgacgtaatgccgattgcgcgccagccgcgccatacccggtgccaatactttgtgcgacagtcataaacatcctcctgatgccgtggctctatccgaaacgaccgtaaattatgaccgcgcgtttatttgcaacgtctgcactatcgccgtgatatgttctttttgctgcggggttaattcaccgaccatggtggcggttaatatcaagacacggggggcgatatcgaccagcgtcataagctggtgtatccgtccctgctctgatgaccagcaaaactcagccgtcactgatgggtgattattgacttcaccggtgtcctgatgcagtaactgatagtgatttaattgccggctcagagagccgatttcccggtcaaagaactcatgaaaccccattccccacgggggcgtatcccgcgacaccgtaaaacttaaccccaccgtttcatccagagacgatgtcagcacatttaccgtcatatcgcgccatgcctcaggcaactctagggaaccctcgttgaagtaatacatgcttatcccttgtctttatttaagttaatcaatggcgcgatggcgtcaatattggcggcattcagcgtaatagaggtagagccagaaaattgcagaataatagagtccggatttaaggtaatgctgctcttgcccaccacgaactttatctgttccgtcgcggtataaagttgcgtaccaggcgcatcaccttcagccttcacctgaataaaattcgcgcaggtactgcgacgcactttgatcgtctcggtcaggctcccttgggtaatatctgtggtttcatttccggtcgcgaccgtgactgtcctgtcacctttttccacggtgacggtttgattacctttctccaccgtcgtcgtctggttatcttttaccgtggtactcatatccttttgagcatgcataaacagcccttcgccgcctttggcgtcttcgaagcgcatttcgttgtagccttcccctttgtgggtttttgagcggaacgccatctgggttttactggccggtaacgaccccggcgggatgttgttggcgtgataggtccgccccgtgacaatcggttgatccggatcgccgtgcagaaaatccaccaccacttcctgaccaatacgcgggatggccagcatgccccagccctggcccgcccacggctgggttacccggatccagcaggagctgttgtcattgctctgcccgtagcgatcccataaaaattgcaggcggatgcgcccgtattcgtcgcagtaaatctcttcccccggcggccccaccaccatggcgatctgcgggccgtccatcgccggtttagccaacggcgtcggccgccaggtctgggtgtgcggaataaaactgaagtggttgaacagcaccgtgccctgatcgccagatgcctgctccagcgcctgcatctgtttgccgctgtgctgaataccgagcaactgccaggcgtggttcaggtcactacgtgggtggttgtacaggctgaacaactgccccggctggagggtaaaatcattgctcgccccctgccccagattggcgtcattgcgcagtgcgtccagccggtagcgggtaaaatcctgcccgtgctgggcatctttgaagcgccccggaaaatcaaaatgctcgtagtccggtcgctggttttgcagttctcccgactgttcgctgaaggccgcggcccagttcgggtttttaaaggtgtagtctttcagttgcaccatcgccgggcgcacctgcgcactgcgggtgaaggtggtgatactcagttcctgcgcctgcgccgccacattcgggttatagggcagtgacgcgcctttcggcagggagccaacatcatcggcatacaccacggtatttttcccggcgctgaactcgaagtagtagaaaatcccctcttctgccgtcaggcgctggataaaatcaaaatcggactcctgatattgcacgcagaactcgcgcaccgggtgcgggtggcgaaaaccaaaagcaaaatcgttgatgccgttctctttcagcagggtggtgatgatctcttccaccgaggcctgctggaagatgcgggcattgcgccgcaggctggtgcgccatagcgccgggcggatcaccatgctgtagcgggtctgatgaaaaccggtatcgccctgttcaaagctggcgaccatgccggtgatgctgcgttgcagtaccccttcgcgccagataaacagcgtggcgtcttcatccaataccgccgcaaaatctaccgccggatcggcactcgccagcccgacattgagcacaaacggcgtggagagcatctcgctcagggtgaaatccaccaccgcaaaggtctggggcggtaaaccggccgccgtcagggtaaattgcaggcctgagggctgtttgaccaggcgggtaagcgccgccgccgcgctgtccggcaatcccgccccggccccgcccgcggccagattcagcggcgtgacgccgccgtccaggacttttgccttggcatccagggcggttttagccacctcggcggcctgattgatgcgcttaccggcagtgccgcccaccgcatccccaatccccccggccatctcggtcatctgagcgccactcacggttggggcggcctccggcgagacgatatgggtcggcgtcaccgtgccggtcttgtccgcggctttattattattagctttatcatgagcaaacatcgcgttgctgtctcctggaggttaacgggcagagttcgtctgctgcgttaagtggtgataacggctgagtaaggcattccagcggtcatcaatttgttttatcaagaccggcgaggccggttgatgttcatcggcggataccgccagctgccgcagtaattcctccagcggtatctcccggttcagctcggtctgcatctggtaaactgctgtttttagataggagatagtcagactgccccgagaacgttccttttttaaaatacgttaacatttaatttgcatcgtattacgatatctaatagcatcgctatacgatgtgtattcgtttttaaaagtggccttatactggagcatcttatgactgacgtgatagacgagattatgcagacggaagaacagcgccgggcatttggcctacggctaaaagaattacgtaaacaacaacataaaacacaaaaggaagtcgcgacccgtattggcttgcaactttcacagtacaataaatatgaatcagggatgcatattccaccggcggataaattaattacgctggctgagttactggttaccagcattgattatctgctacttggctcgtctaacgagacctcatcgattaggaatacgcgcttattagagcgttttaaagccttgtcgcagtgccaaccggaagagcaggaaaccgtgattaagttaattgatgcggtgattgtgaagcatcgggttgaatcggctttacagccagttgacccagagaagaagtgataaccacagtattttaacacagggttgaggtgtatcagcacctcagccccgctaaccacaagcaactaagcaggagttactatggctaaggcacattctacgtcaggaactggcataaataaaacaccgaaaacagagcgttattacacggtgggatatgtcccgcaaagaggtaagcgcaacccaccgcccgctatcaatcttaaaggccgctggcttgaagcgctgggtttcttctctggacaaccggtacttatcaccgtcgaacatggacgactcattattcagccggagataaaaatatgaatgggaatattattctcaattgtattatgaacaataatattcctgaactcattatcgacaaacccgatattattaatgcaggatttacgcccggcgcagtatttaaaatacaacaatatcggaatggcctgataataaccttaatcgccaatgagatcgcaacccaacaggtatttaatgagattgaaaacgatcaccatattggcatggactggatacaagataatggtgaactgtctctgtccggagaatggctcacgcaaacaggcttaaccgggcaaccgctggcgattagcgtgatggcgggtaaggtgattgttcgggggcagcagggtaatatgttggtgtagcaactgataaaaataactggaaagatccaaagaggatctttccaagttactctttaaaattatgctgtctggacaaagaacaaaccagcattattataatcatcaatatctttttttagaaaaagataaccaattgcatctgacagacctaatatccctccgtcttttgatggtatatcggccgagtacagttgacatataaaatcatattcttttataagcttctcagagccaatcatcccatttggaatctgatttgataaaaaagaaaaagcagggtaatcattatccattatttttctttcctctaatttaatatttttacaagcaagatgattattgttcacactcagttttgaactttcactaagagttactcttgtaaatccagattttatataatccaactccacatcatcaccaaaaaaaactatatcgtctagaaaatatctgttctcattataggttgaaaacacagatataaactttccatctggaaggtggaaaaaattgttatttttatttaactgatcattatttatagtaagtagtaatgacaggtcttctccaagaggatttttgggccattcattttcaatgaatgccccgccgccaaatttaatcccgctatcttcattatgtatagacgtatgtataaattgataaacttttcgcataatatctccgttaacacccagaaagattgccataaaatttttccgcgttgcctcgtaatttactaatttgtgtttcaggaacacccgctcttttcatggcttcagatgttatatctaactcatccgctatttttgaggcaaattggttaattccaagtcctctctcagctctaacctgagcttcatggtaatgaacaccaccaatgcctctagaatcttttaatggtccccgagtatggtgatcaaggtctaacgcaatagaaggattcgaagataaacgagtatcattagctaatcctaattgcttaagaaattcatgacgaataagctcatgtgcttgtaaaccatcgccgacatgaatccctccatttaaaccgccataagtacctaaatcaaaaagattagctagtcctaaaggatccacccaacctagcggatttggcccatactgataaagattcaccccccccgccagccctatcgggtcctgcgtgctaaatcgccctatctccgggtcatagtacctgaacgtattgtagtgcaaacccgtctcgtcatcactgtattgccccggataacgcagcggctgcgcgaaccggctgaccgtgctttgccttggatcgctgacattctgccgggtgactttgccccaggcgtggtatttccctgaccagcggtgcttaccctctccgtccgtgacatccagcggggtaccattgatatccgtatgaaaataatacacctgactttctgtctcgccatgacgctgatcgacccgtgccagcggcgtataactttcgttcgggtcgtaaatataggtcgcgttgccgtccgcatgttgctcctgcaataaccgcaacccctgccagataaaatcggtctgacgggtggttttttctgcgccgcgctttatcgtcaccgatttgtggatacgccgccccagcgcatcataccgatagtggctgtcatgctcccctaacggcccggttccccaggcccgcagcagccggttatcatcgtcataggcaaaatgttgcatccgaccaccggcatgccgcgtggtcatgtttccccaggcatcatactcaaaacggtaatgctgccattgcgtcaaacggttgttggcgaccggtgtatcgtacagtggatcgacggtgtcaaacggcagtttcctcaggttcagcaggttatccgcattgtcgtaagcaaaatcctccgcaacggataactgatgacgctcccggctgtcagtcagccgcccttccgcatcataacggtactgctgctcaccccggataaaatcggtggccatgctcagttcaccggcagtgtcaaagctgaatttacgccagatatccccctgacggggcagcagatcggccgccactgtcggcgcatcagaacccgccgattgccacaaccgccgccccatcgcgtcataatcacgatactgcgtcaaaataccctgggtccggctcacttcccgatgaaggttatcccggctgaactcggaaataagcgtatcaccatgacgaatggcactgacatggcccgcaccgtaacgcaaccatgacagcgtctgaccatcgggcagcgtcagggcggccaggtgatgcagcggatcccactgatacgtcaccgcacccaggtcaccgctttccgtcagtaaatgcccggccttgtcatacgccaaacgaacaccatgaccgacgatccccgcctgttcgcccaccgccgttggcacacgctcggccaacaataaacggtccataatgtcccagtcataccgggtcgcactcatgcccgtcaggcgctgcgtcattcgcccgcccgcatcatagtcaaaactgacctgccgggagacggtaagatcgtcaaccgtgggcgcggtggtctccagcgccatcagcatcccgctctccccatagcgataacgccggacaaggttatcgggatactgctcttccaccaattgcccgccactgctccaccggaagtgatactggccaccattggcattatccagctcaatcatctgcccatggcagtcatagcggtaacggtattcccgttgcagacgatcagtaaagctgaccggctgaccccgcaggttataacgccagtgcaactgccgcccgacaggatcggtaaactgttcaaccagcccctgagcgttataccgcaactgctctttgcggccatcggcgtacctgaccccggtgggctgcccgagacggttgtagctgtaatgtgttgaatggttttcagcatcgatgaccgtcagcagatggccatcgatatcatattcgtagcgggtcagtttacccgagcagtcggtgtgctccgtcagttgcccgtgcctttcccaaccaaggtgtgtctgcgcccctacggcattggttatgcgttcaggaagggatgaggcccctggataatgataaagcgtcaccccgccatccggcgcgttctctttcagcaaacggccggtacggtcatattcccccttccagacctgcccgtcagggtactgacggcgcaccacccgcagactgttacggtgataatcaatgtgggtttcacgttttagcggatcggtgatctggatcgggcgcgccagtgcatcgtaaaccagaacgagcgttctctcgcctgccagcacaacgcgtaccggcatattgaggtcgttgtagtcaaatgcatatttcccgccatcaaaatcccgatagtcggtaattaaatgttgggcgttatatccccagcaggcggtctgcccggtattgaggtccgtcagggtggtctgttgattgtcgatatcataatcaaactgccactgctcccccagattggtggcactgtgcgtaattcgcggggttccgccgatatcagcccatgtgtaacggcactccagccccctgacatccgccagtttattgatcagatggccatggtaaccaaactggcgggtgatttgcccctcacggttagtgacgctgaccaactggtgctgttcattatactggtagcggaccagtgtgcccggcgtaccgcccttgacgcaggcaacggacaccagacgccctttttcatactggcaatacaccccatagccgctggtggtcgatatttttttcagttgcccgatatcgtcataaaagaaatacagggcatgaccattgagatcttcgaggctggctaatttcgcgacgccagcctcagaaaaggcctcaaaaataaaacaggtttcaaacgggctgctgatggcataggtatcacgctcggtacgtgccagccagatatgctccgtgggggagaaatagcgctctccacgtttaatcaggggaaagacaatctcccgaccttcatcattctgataaacaatgctgtcatcttctttgcgtaatgaacgctcccataccagagaccagccttgtcccagcgccccgacatggtgattttcactgcgataaatccggctccagtgcagcgggaagatacccggcagaataaaatcggtatcatcgccctcacctgtcagcaatttctgtccactgatcacatcaaccgggtaaccgaaataaccggcgatggccccaacccctttttccaacccatacccggcagccgccccggccatctcacccaacgcaatcttgctcaggcatttaaggccgaaacaccccgcctgttttgccgccccaaatatgccgcccgccagcccggcgacaataaacagcttctctgacaaatcacgcatttcatcagaaatctcgcgtttaatatcgagatactgaacgcgccccccaccaaacgtcacattactggaagcggaatcgacaaccgcatcacaggtcgttttatcttccagacgaacggcggctttattgttaataaagatatttgacgaaccttcggccatgcgctgaatggcggagtcatctttacaggccacggtactgagctcgacatgcgccgcccgtttactgttcactttaacgtttttggaccctgtcgtaatttgtccgacatcgtgatggcacatgctccctattttttcgcccacggagcgtattaacccaccggcaacgacgcccagcgtggtcacccccatacccacaataaagccggtagcgaccagcgtcgccccgccggtgagaacaatggaggcggcgtaagccgcggccgcaaaaatcacggcggcaccaataatggagccaataataaaacccgctaaggcactggaatgataaagcttgtcatcaacacgggccgcttcaaacatggccggcctccctggcccacggcgcaaagctgtggatccactgctcccaggtagcctgctgctgcgggttaaacggcgaggcattcgtggccgtaaaaatcatcatatggtcgcctacctgaatcgcgacctgtctctgccacacccttcgggtttcagccatataagtggcttcaacatattctccggggatgtgttgcgccccgacgtcaatctgctggtgctttttgacttcatactttttaaggttatcttttaatatgccaatctggcgttgtacgtagtcactcaggacttcatgagcctcggggacatcgcgggcgatattcagggcaaaagcagcgcccggtttgcctttcataaagaggttcaccgtacggtcagtgaaaccctctggacattccagcgttccttcctgaatacagtaagtgttgatgttattttctggcatccctgctactcctctggattaagatcgatcatatcggccgctaaacgaatgtatttcccttgcagaacaatggcaccgtcatgggtgatcgtaattccggcattcggggttgatatgctgatatcaccttgtttggcatgcattttaatgcttttcgtcaccgtgagcgtttcgtcttcatgcacttcggtgtaacgaattttcgtcacaaactctttcttttcacctttcaccactagctggtaatcattgcccacttcggtttgttgatcgcgagtcacctctacccggcgatcattttggatcgtattactttggttacgcacaaccgtcacggactggtcttgcccaatgtgctctgaatggtcctgagtcacatcggttttgcgatcattcagcaccatggtcgtcatatctttctgcgcatgcataaacagcccttcgccgcctttggcgtcttcgaagcgcatttcgttgtagccttcccctttgtgggtttttgagcggaacgccatctgggttttactggccggtaacgaccccggcgggatgttgttggcgtgataggtccgccccgtgacaatcggttgatccggatcgccgtgcagaaaatccaccaccacttcctgaccaatacgcgggatggccagcatgccccagccctggcccgcccacggctgggttacccggatccagcaggagctgttgtcattgctctgcccgtagcgatcccataaaaattgcaggcggatgcgcccgtattcgtcgcagtaaatctcttcccccggcggccccaccaccatggcgatctgcgggccgtccatcgccggtttagccaacggcgtcggccgccaggtctgggtgtgcggaataaaactgaagtggttgaacagcaccgtgccctgatcgccagatgcctgctccagcgcctgcatctgtttgccgctgtgctgaataccgagcaactgccaggcgtggttcaggtcactacgtgggtggttgtacaggctgaacaactgccccggctggagggtaaaatcattgctcgccccctgccccagattggcgtcattgcgcagtgcgtccagccggtagcgggtaaaatcctgcccgtgctgggcatctttgaagcgccccggaaaatcaaaatgctcgtagtccggtcgctggttttgcagttctcccgactgttcgctgaaggccgcggcccagttcgggtttttaaaggtgtagtctttcagttgcaccatcgccgggcgcacctgcgcactgcgggtgaaggtggtgatactcagttcctgcgcctgcgccgccacattcgggttatagggcagtgacgcgcctttcggcagggagccaacatcatcggcatacaccacggtatttttcccggcgctgaactcgaagtagtagaaaatcccctcttctgccgtcaggcgctggataaaatcaaaatcggactcctgatattgcacgcagaactcgcgcaccgggtgcgggtggcgaaaaccaaaagcaaaatcgttgatgccgttctctttcagcagggtggtgatgatctcttccaccgaggcctgctggaagatgcgggcattgcgccgcaggctggtgcgccatagcgccgggcggatcaccatgctgtagcgggtctgatgaaaaccggtatcgccctgttcaaagctggcgaccatgccggtgatgctgcgttgcagtaccccttcgcgccagataaacagcgtggcgtcttcatccaataccgccgcaaaatctaccgccggatcggcactcgccagcccgacattgagcacaaacggcgtggagagcatctcgctcagggtgaaatccaccaccgcaaaggtctggggcggtaaaccggccgccgtcagggtaaattgcaggcctgagggctgtttgaccaggcgggtaagcgccgccgccgcgctgtccggcaatcccgccccggccccgcccgcggccagattcagcggcgtgacgccgccgtccaggacttttgccttggcatccagggcggttttagccacctcggcggcctgattgatgcgcttaccggcagtgccgcccaccgcatccccaatccccccggccatctcggtcatctgagcgccactcacggttggggcggcctccggcgagacgatatgggtcggcgtcaccgtgccggtcttgtccgcggctttattattagctttatcatgagcaaacatcgcgttgctgtctcctggaggttaacgggcagagttcgtctgctgcgttaagtggtgataacggctgagtaaggcgttccagcggtcatcaatttgttttatcaagaccggcgaggccggttgatgttcatcggcggacaccgccaactggcgcagtaactcctccagcggtatctcccggttcagctcggtctgcatctggtaaactgctgtttttagataggagatagtcagactgccccgagaacgttcctgttcgagtaatttttcagacagcgcatgcaagcgctgctggagctggaaatagctgctgtcggtaccggccaggccgatacgcgcctccaccaaccgcgcccagcgctggctttcggccacctgactgggatcggacggccagcgttgacgagccatcgccaccgactggtcggcggtattgagcacaaacaggggcgagaggttttccagggtgctcagttgctcaccataggtggcgacatccgggcggttgagccacagcaatgccgcgctttccggttgggtggccagcaccgtcatttgctgttgcagcggtttgaactgggtaacgtaaaccgcagtcgccaccagtaaactgcacaggacaccggcaccaaagccccacagcaccgccccccgtttggtctccggggggggcgaacgcacctcaatattggccgcaggctcaggggctgccgctgccgtccggacaggctcggcctcgggtaccgagagatagaccataggcggcattttcagcggggccgcagtttgctgagccttcgccgcgtcactggccgattcgagttttttggcggtgttctgcatcaggtacagcaggttttcaatgcgcggtacccgttttaattcaacctgttgcaatttatcgtacagcaactgcaaggcccgctcagcgcggtacaccagccgcagatcgtcacgggtaaaatcatgctgacgcagttgattgctgacgcgggtattgaaccattccagtatttcactgcgtgcctgcggctgttctggccacaggtgatcccactggccgaccaccataccggccagcaactcgcagccctcggtgaaaccggccaggccatttttttgggtgcgggccagcgtgtaatacaccgccgtctgcaaatccacgccgtgggtacggaacagggtcagcgccagtgattcaatcaaaccccagttgacctctggccgtgccgggtggttgattttgttgatctcttcacggatggcgttaaattccggccggttccgtgggtcagtgccggttttaatgatgatatgttgcggggtgtcactcatgcagactcatcctttgatcgtcttcctgccgcctaagcagcaggaagacgtgatgacaacgattaatacgatttgcctcaatgcatctgtttcaatgcgatctgtctcaatacaaccgtgtgtctcaatacagagtgtctggcagactgaatttactgaacaaaccgcccgcgaatgggttgtcggattcatcaacaaagatgcggtacgtcatctcgccgccatcaaccttgaagcggacatcgaaggagttggtgcccacattggtcagttcaccggcgttgatcagccgcaactgcgcccaaggaccgctgaagctgagggtgcgcggtgatttgccgctctcatccgggactaacgtcagtttgctttccactcctgcacgcatcgagtttggccaaaccagatgcactacgccgctgcggccatgggcgtaatccagtaattgcccatccagattcaatacgctgcggcgcttgttgccacttaacagcaccggttcaatcgcaaactgtgtgcccaggccgttttgggccgagaagaaggtgtcgcgaattttccgcgcctgcgccagttgctgtaacacatcaggccggatcagcaattcgccatcgctgccaccggtcaggttgttttcgacaaacggtttcaggttctgctgatagaatgcatcgagcgtgcctttcggcccgaagaagcgttcaaactcactgagtggtacatcctgtttcgcgtgaggatcgaagggataacgtccggccaggtaggtttgatactgtttgatcaccgtctcattccactccacttccagtgactggatagcctccatcatcaccacccgccaggcttgctctgccagttcgcccacccagcggtttagcggctccggcaggtttttagccagttgctggacttcgaaaatcggatcactgttgttttgatccagacgtaattgcaccgccttcaacgccgctttgcccggcgcgggcgagttttggatcgccaacagatagcggtgtagctcggtcagtttttggtaaacactttggatcacgctgcctttatcgccattctccaccagcaccgccgtttcgggggagaactcacggttgatgcgggtcagcagcaggtaatcgggtttttgcagcagctcttgctgctccttcgcggggatcagatccgagataaccggcaagcgggtgttgtcactcagcgtttgcagtgcacggcggaaaggttgttccccgctgatcacctgttcaatggcgctgatcgcctgtggcaagccttcaaaatcactgaccgataggttattcatggccgcacgccaggtggcggtatagtcgccaagatactgttcggtcacctggcgatggatctctttgcggtctgcctcgctgtattcgacgttcttggtgagattaagtacccaactgtccatcaccgtgagatcaaccagttgatcgttctgtttgatgaagtaactctgtaagccgctacgggtcagaaattgcgggatcaccagcaggcgatcgttaccggagacaaagatgtcgtcaaaacttgcgccgatctgatcgcgcaaatcgagcgcgggcggcaacgcatcctgtgctttgatccgcaggttctgatacacccgttggtagatcgagagtttgctcaactcttgctgcgctgactggatcgggctgaggtacgggacaaagctcttgatcgcatattgatcgccactttcccgtgcgccgtgccagtcggtgtgtttcagtgcgtagttcaggtggctcgacagttgctcctgcaactcgcgctggccgttgaattgttggctccagcggtggctcatatattgttcaaccagcgcggcattgcggccactgccgtcttccaacatccgcatcacccgcagaatttccagtttctcttcactgcccttcggtgcggcgttcagttgttccaacagcccgctcatcagtgccgggacaaaacgttgctgtaggagttgcaagtaagtgctttcgacataaggcccgatattattgccctgatataaccccatatccgccaggaacgggctgcgttcatggtaattaccgtaagccagcgtggcgtcacggatggggtttagcagcggcagttgcagattgccataacggtcatcgccttctggcggtgggatcgataagaaggtttttgcctgggttaatacctcttcgccagcccggtagttaagctggtgatagtagtgccagtagccccataaggtcagcgcggccagggcacccacccccgagaaaatgaacattcgctttctcgttttttgtagccagataccgttctctccggccagattgggttcggccaacagcacctggttaaacagcgctttggtaaaatacggcgtcgtatccgagaccggccaggtcgggaaggcctgtggtgcaaggtgatattgcaccgcggcagattgagtaaagatatcgtccatttgcccacgttgctgggcagacgtgagataaaccccccgtaacagcggctgggcatgttctccacggtacagaatgccttccagcagttgcacgacgtaatcgtgcaggccctgcatctggcgagtgaagctaaacaactggctacgctgcccggcatccacactgttcagcatcatgtccggcatcgcgccattcagttgtgcgacccattgctgccagaactgtttcaactccgtccgccacacgtccggatccgccgcattgaggctgaacgtcacccccagaaccgcttcacgttcggctttatccagcgattggtacatggcctcgaagccgtacagcaggtccattttggtgaacaccacatacagcggcacctggctgtgcaaagacagccgtatctcttgcagccgttgatgaatatcagcgacgtacgtctcccgctgcgctttattcgcggtcatcatctgatgaagatcgacggtgagaataatgccgtttagcggctgacgctggcgctgttcaatcagccaggataatagactttgccataagcggctgttgagtgatgctttgcccgcgatcggtgtcgtaggttgttcaatcagcacccccgcaggatcgataataaccgcttgttcccccaaccagcagcggacgcgcagatctgctgcgccttccacatggagccgctcggatgcggagatctctgtcagtttatacccttctttgatcagtgtacttttgccgctattgcgcgcaccaatgaccatgtaccagggcaggcgatacagatattctggggtgttcaaatggcgctgaagttggtgcttccagccattgaggtagtggttttgttgttcgatatcagcactgacggggtcatcgagctgaattttcgtttgcagttggagtttttccaggtgttgtactcgcctcatgactttcaggctgagccaacaaacggccaccaagacaaataccgccgtgaccaaccaacggctcaataatgtctcaaacgggtaattttcccccaattgccactcgggtccgtaaatccatacccaaatgagtgccgcacaagccatcaacgccaataccaccggtattgacgctttaaggcgaggaatggcgggcttggctatgcgtataaagaacggcaatttcatgcgctaacgctcctgtggcattccatggcgatcatggtttgagttgtcgctgtttttctgtcagtagagcgatcaacgcaggttcccattcgcttagctgtaattgctgccctaccagtaataagctgtggtagtgctgctgcgccaatgcggttaaccctgctttttcgaacaactgtgcactgagcaattgatggtaaaaacggtcccgaggttcggattgctgtggttgccggtttatcatctgtagtgcggcttccaatccttgctgttgatagcattgccaaatttcatcctgttcaatagtgcgacttcttccctgatgattcgcatcctgctgtaaccaggcggcagattcagaggagaggaatggcgtcatatccgtaaaaaagagggtttttaatgcgggaatacgggctaaaaaaacgctgagttcatcacggatagcctgtgccaccgcgtcataacccagttgcagggcgatttgtgccgaaagcacatgcccatccagccaataaggcgcgagggtgaggctctgctccacttggtgccacaaaggcaaatcggcattagccagacgtgctaagtaatcggcggttcgatccgcagaaactgcggccaacggggtgcggccatcgctctgcgccataggtggcgcggttaacgcgccccatacggcatggcggcgtaaccggaaaccgatagcggcatcgggttgctgttcgctcagtaaatccgccattttcagcaaggtctgccgccaggctctgtcgctcgtgttatctatggcgaggcttgggctaacgggggtggcggccattgccgccgccaaggtgttggatgagagcggttcatcagaagccactgcttcgataacccgctccggtggccgcgcatagcggctgcgtaatgcatccacctctttagccagacccggctcacggctatgccaaacctgtgctaaatgtgccaataatccttgcacattctcacgttgagcctcgtccgctcgttggctaaaactgctgctggcgctgtcaaagcgttttaggatttgttgggcaaagcgccgtttgtgtaaaggattttgcggccaggccgtagtccaaaatagctggacgtattcggtcagcaacgacatcgccagcattaattcatctggctggcccccgtgttgtagggtgcgcagtagatgcaccacgagccggaagtctttacttttctgtgataacagcgccatggcttgttgctgaatatcatcaatattcagcgtggcgtgggccaatgaccccagtttcaccatctggccgtcgatatattcccattgggggtcatcatcggccagggcttgtgcggtctgctcaggtgacaaaggggcttgtaacaagacatgccagggatgttgtgacgtgatatccatatgcctcaccaatgacatgcgttacgcagcggtttcaacgctggcgttaactgagaaagagtaaatgtcagccgaggaaaagcaccgtttgccccttcgatggtcagggtttccgctgacatcaaccgcttaatttcatcgatacccgccaggccacggctggattccagtaaatagccgttttcacgcaggaaccactgtgcgtccagacgggttttgtcgataattccggctttgtcgataatcaacgtaacggaactctctttttgtggccccaccagcgcaatctgtaagcgggtgatattgtcaatgcagctcaacatcagtaccggccgtggaggtggcatgccaatcgcaggggtggtaatgagcaccatcggattcgagccttcgccttccgtcaccagaaatgcggtggagtgatcagtgcgtcccttttcctgattcatcgctcgctgccaggcagggccagcatttacccgtttttcatcgacggcgttcactggcgagagcgctttgtcataacagtccagccgtaccagagccgagttttcgctacggcaacgcatcaccagtgccagcgtccccgcctcctctttttccgccaccgggggggttaatcccatcgtccaaaaagcgccggtatggccgccggaaaacagtaacgagctaatcaataaccacgtgttcatagctggcacctgtatttcgctaacttatacgtcaaggcgcgcagtgatagccccaaactggccgcaatacggcttttgtcattaccgtacaggcgctggcgctgggtcaatacagcacattcgaaggtctcgaccgccgtggtcaggctgtctattttgctgtagtcttgagagattccgggcaaggcgtgcgtatctgaggtactgagcgagaccaataactcatctaattgcttttcccgctgtcgctgctctttaaataccgttcggatctgattaaattgcgatctcagttggtccatctcctgtaatttgttcaggcgatgctgaaagatgtggcaataaatactaaatatgccgcgagtatcagcgaagcgttcgatattttcggaaaaaaccgcaatcacgccgcaggcatgtccatgaacgtcaaacagcggtaaggcgtacagcccacacctcgtgggtaacgcctgaatgaagctgcgaaaatcatcatcttcgatgcgtaccccctgatacaggctgccccacacttcggggaaaccattgcgcaaaacccgaaccaacggatggttaacatcttcaatattcgcatccagcttcaacgcaacgttcatgccgccatccggctggtgataacaatcaagacgcccttcactggcgttaaacatcgacaccatcagggcgctaaatcgttggcggtggtggttaatcgtcagaaagcgatggatcagttgttcggttgagtcattgtccagcagtgcgaggacactctttaaccgttgtctcatatcgctccctcaacctgtgcagtaaacacattcccctctaccgcgatccgaatgtggctgatagcggtgccagcggccactttctgtaataacaacagagaaaccggtggtaatagcgcaccgtcgataatcgactcgagcatacgcgcaccattttcggcacgggtcgcgcgtagcaggatttcgtcgatcacttcaggttcaatgaccacatcagcactaaagcgttggcgcagcagcgtatccagacggttcagtttgccgtgaatgataatttgcagcgtttccatgcccagcggcagataaggaaccacttccatgcgggccagtagcgcaggtttaaagaatgccgatagctcggggtagagccgttcattgagcaatgcaggctcgtctgcatgatcaacaatggtctggtatcccagattggaggtcaggaaaaatacgatatttttgcaatcgatgatgcggccttcaccgtccgccaactcgcccttatcgaaggcctgataaaacagatttagcacatcggggtgggctttttccacttcatccagtagcactaccgagtaaggtttttgacgaatagcttcggtcagtacgccgccttcaccatacccgacgtagcccggaggtgaaccaatcaggcgcgagacggtatgcttctcttggaattcggacatattgatggtggtgagatattggcggccaccatagagcaggtcggcaatctgtagcacggtttccgttttacccacgccgctaggtccaaccaacaggaaagcccccattgggcgacctgggcgacgtaaatccgcccttgcggtcagcaagtgttggtgcaagcaatggatagccgtctcttgtcctttgatctgctgccccagataagagggcaattcagtaaccaccgccaattcactctgagaaaggcggtttagcggtacaccggtccattccgcgatcaccgccgcaatctggctcttatccacatggggcgagaccagcgtctggtgctgttgcaaccgttccaactcatcgctcagcgctgtcagattgaccacttgctcatctgtggcgctctcttcttgtgccaacaggaccgctctcagtgcgataatctgctggaccaaatgttgttgcttttcccaaccggtattcagggcaatgagttgctgttcgatctcaattcgctgctgttgtaaaacggataaccgctcatccgggcggcttaagctgaggcgttgctcccgctccagcatctcgatttccatcccctgatggtagagttcgtttttcagtgccgaaacctgacgcggtgcagaggtgagattgatggcaacacgtgcggctgcggtatctaacacgtcgatggctttatctggcaactgccgccctgaaatatagcggtcactgagcaccgccgcagcttgcaatgcttcatcatcgatcaggacgccatgcgcctgttcataaactgtacgtaggccacgcatgataatcgtggcctcttgcgcgctgggttcagaaactttgaccaactggaaacggcgcgacagcgcagcatctttttcaaagtattttttgtattcgctccaggtggttgccgcaatcgttttcagttcaccacgcgctaaagcgggtttgagcagattggaaatgtctaacccgccctgttggttaccggccccgatcagcgtgtgtgcttcatcaataaacaggataattggcgtcgtggactgcgcaatttccgccatgatgcccttgaaacgcttctcaaattcgcctttcactgccgcgccagcctgaagcgcgcctaaatccagcgtcatcaactcgctgttacgcagtttttctggcacctgattatccacgatacgcagggctaaaccttcgatcagcgcacttttccctacccccgcttcacccaccactatcgggttatttttgcggcggcggcacagaatatcgatcatcagatcgatttcggtatcccgacacagcacagggtctaattccccgttacgggcctgttcggtcatattgctggcatagcgggccagcaagctgtcaccattgatttctgcgccgttgccagcttcagcccctttttctgctcgcggtgtttctgctgagtctgccgtccagttagcaaaattctgacgcagtaactcacggttaatcggagacagtagccggttggccgtaggaaccagatagcgcgacgggctgagcaataacgtcaataacatcacgccgctacggagttggctgtgttccatctctgtcgatgccagcaaccaactgtcttgtaaccattccaccagtaatggggaaaaactcgggtaggcctgggtaatagcttgatagcctgaaacacgttgatcgagcgactcccgtagttcatcctcctcaacacccgcatggctcaggattaacctgacatcacataatggtgtggagatcatttgcagtagcacttgggagaccgtaatttcagcttcctgctgactgacgcaatgcgccgccgccgcttccagagaatggcgggcaatgggattaaggcggtttacgagtgtgggcaagtcaatttgaatcatttgtgctttcctagctcaataaattgtttagctgttgcaaaatatcctgactttgggtgtgcaggtggatggcataaaacagataaatcaccaccagcagactcacgccaccccataacaaatgcttgatagtcaaccgtttactcaagtggtagcggctattcagacggccgcccccttgataaaggaccgtcggcggcgcatcaccccgtaactgctgtaattgatgatgcaatcggcggaacaatcgctcaaagtcatcaccgttttgtgatgtcactttgtagcggccgcggtaacccaaacaaaaacagagatagataaactccagcaggtcttggtaacgcttgggttcccccattaagcgttccagcaggacgtacactttctctccgccccaggtttcattatgaaaatgcaccaacagagattgctgtaaccaaccgttttgggtgttccagccatgccctaatgccgtttcatcgatgaatgtgcacagcacatatcggaaagatatgattgcgccgggttcgtagcctttggtttgcaagtactgctcaatagcacggatatccgtcaccacctgctgatatagctggtccggtaacgcttggttttccatgtctttcaggcgcagtaccatccccaataatggggtggcggtatcgatcatcgcgttcaagctttcgccacgtagcggtagctgatactgccgatgggaggtgaccgcttccgctgcggggaaaggggtgttgtcagtcacagcatctgttttcattagctgctcctgattgcccagaattgcatgtccagatcagggaaatcacccgagacgtggaaggcaatcgcattgctttgctggatttctttccatacagggctttgcagatccagcatgaagtaggtgtatcccgagtggtaaggcagctggcgcggtgcggcggacagtgccaccaacgggacgccgggcagttggacactgaccaaatcgcgtattttctcaagtgaggtgattttggtttgctgaacaaactgccgacgcaattgttcttgaggtatttgcgcccgaaccgccagcacaaaatcagcactgcgcaatagatcactatcattaatggtcgcaacgcgaataccgtgtgcctgcatatgcaactggatagagatggcacgcggtgtgagcacggtgcttaatgcctgacgcatcgccaaaaacaacggctgaaaactgtcggtcaagttatcgtggttataaaccgggaaggtgcccgctaagcgagattcatcggtaaacgtgcgcagttcaccgcaggtttgtaccaactgatggtaaaacgcttctggatgcagaatcgcctgatgtgccaaatgggtaaagagcggctgtgtccggttaaagacctgcaacatcataaattcagccacatccgcgatcccctgctgaccgggagaaccaatacgtttcgccagtagttgggcgcgttcaaccaatgtcccttcgacttcatccataaagccttttaactgcgttgaaacactgagcgtggtgcaggtaggaatgaactcttcatccaagatcagcgaaccgtcaggccgtttctctttgacccgacacagcggcaggaccgagtaagcactgaggtcttccgagccttgcatcaaacgcggtgccagttgtgccagtaccaactggctgacatcgcccccttcggtatgtaaatcgcggacatcatcgctgtgttcacgatagcgaagggttcccggcgcttgcccctgctggcctgccacctcattaatggcatcgtttagcatcggtaatgccagataaatgtcacggctggccgcatcattacaattcagtacatccaatggctttggtgaatagtcttgataagggatatcaaacaccgtgccatcagccatattgccactggcgaccgtcaagccaatacgccctaatttcaataactcctgattcaggatcagtgaactgaaaccatagctatacccttgcagagcgataatccggcgttgtaactggtagtcgttatgccgttgctgttgttgaaaatgttgcggtttgatgaacagcccttcgcgccaaatcactcgattcttggttggcatggttattcttcctctttccttagatcgacatcgtttgatctgacatggaccaaaacctggtagttatggccgatcccttttattttgatgatcttcttccattcactgcggttggcatcggcatagtgagcaatcacccccagatagctgtttttctcttccagcttgatagggtccagcgccttgaattgatcgggcagtaaggtgtattcctgatgatcgatgtaattcttacccagcgttttctccagcgcgtcactgcttagctgatcataatccgcggccagcagcttggagttttcacttaggtacaccaccactatctcagtcggtaccgcttcccctttttcattagggttggtatcgggatcggacagcaatgttagcctgaccgttgagggttgatcggtagcctgccccaccggaatatcagggtccataaccaccttgccgacctttttagtggcttcccatgcaccgctgcacccagacaacaggaacaccacacataatgcccacgtcaggagatagcctctggcgttgttcattactcgctatccttcatgccttgacgtaaggcccggtcataggcttgctcatacacttcgccaaacagtttttcaaaaccttgctggcggctggaggccagctcgttatagtagtttttgtacatatcccacgcccaggcggagtcctgctcttgccgctcattactgcgcaaataatgggtaaaacgcgtcagtaaacgctcaggggagaaggcttccaacatggtgttcaaggcttgcgtaatcgcctgttgattggcctgatgatgcaaacgcaggttatccaggctttcggccacggcggcgggcgctgaaagatgaaccgggcttttttgatcggcaaacatcaagttgagggtggtgtcgtaatccatattcagacgcaatggattatcttcaatcggccgtaagtgcttatcacgcaagccatgttggctgcgttgtaaggcgagcagaccttcgattgtcgctttgagtgttttacccgcctcttcaaggaaatcgtgagcttcctggctgttgcggatcgggagttgagcgtcaaaaccacgcatcagcggcgtaatggcaacgtgatgttgttccatttggttattgagtccttctggtttgccccccgcttgtttaccgttaagaaaggtactgatctgcgggagatcgataaacgcctgatccatagcactgtccttgggggtatcagagagcggggaagagaaaagtgggttacggtatcggtcctgctgtagagagtgatcagcatcagatatcacggcgtcatggccttgcgtagtcaggctttccgtttccaatacccgtaatggatcatggctgaaattatggctaaccgtcgcggctaaccggctgtcttgctgatgatgaggcgaggccaacggctccccctccatcatggcatccatcgggttgctgtaactcgataccagtgactctggtgacaccatcagtggatcgatcatatcggcagcagaacggctgatatggcttttgatcaccagattacccaacgtcatttcatccccttgctgtaggcgaacgaaacccgaattgggtgttagcatcgaatgattaatgttcagagagccattcagcatccgcaggcagaaagagccatcacgccattcgatagcaaactgtgacgggctgatattgccgccttggtcctgaatcgaccaatgatggctaccgtcactgccgacactgcccccttgcgcatgaaacaggctgctggcttgtttgccactctctaatttatcgctgttgacgacccgcaatgacagcgttggttgttttttatccatggtgtctcttcctgaatactgattcttatttcataacgctgatcgctatttcacaacgcgggtcgttatttcatcatgccgaccgttattccatcgcgtcggccgttattccattacaccgatcgttattccattacaccaatcgttacgctgggtttctgttcgggatcgccgaggatactggtccagcccaataggctattttgctcggttcccagaaccatcccgcccacctgttgctcggccaacccaaggcgtaaatcccacgcgaattgatcgcgcataatgaaggcgacaaacatcactaacgaggcgtaattagccccgttgggtaaaaaggataagaactgttctcgcgtcagcttattgatgcacaacaagaatttcccgctacgatccgcaacccgtgaaccgatggagaaattaacgccaagcactgacttttcatcatatttcttgccacggactttcaccctcgtccccaagcgattctgctgtgagggggcaatatccaccttgcgtagctgccaactgtgtaaggtgatatctggcaaattgaagcaatgtgagacaaggctgcaaattacttcaggtgctctgccggggctggccagcagccctgcataagccagcattttgctgtgattgatctgcaatttattgcggacgacctcgctacctaaccccaccagcgagaacatgcgttgtgaaaatgcatcatcaccgccattgtcaaagcagatgtagtaacggtatttacgccaaatctgatgcagtagcgttaacaggcggtgattgaatacgttcatgaaatccgtcaaccggttctcattctgcgcatcctcccacgctaacgaatcgaggtaatatcctggtagcggcgattggctgccatgcaatccaaggaaagagacctctagctcaaattgacctcgggcggaggtgtccagtgcgatcacatctctggtcgggaatgctaaactggcggtcgatttaaaacggatggcttcattggctggggtcgccacaggggccgcaccttgccacgctaccgccaattggttgagcaattcgaccaattgaaaaaagttataacgtgaaacatccaatgcctgcccttcgggtcttgcctcaaccccatttacattctcaaccccacttacatcctcaaccacacttacatcagtgcatgttgacctgtctgtaccggccattcgtaacattcctgattatcaagattgatgacttttaaaagatgaaacgcattgacgctggcatacagtgagaagaagcgagctaataccgtgctaaagagataaagctcgccttcagagctaaaggccccttgctccagccatagcgtggtttgtagccctctgacaggtaagccacgaaacaaccggtcaatcggttgtgtttcaatacgttggatagcgtccagtttcttttgcgatgccctggcagattgccggttatgcaggcttgggaaatcataggtatgcagaatttgcttcaacgcgtccttatccagtaaggacatgtagttcaacgacatattggagagcaatgaccaatgcaggcccccatccagcaccggatacaacggcacggaaggacgggtaatattgcggaacgtcgcgaatgaagggctgtctgtgctgagttgattgatatcaccaacgcgcaacgacagcggcaactcacggttggtgcacgtcaggctgaccgagacattctcttcagcaagcaccagcttcgattcatcactgcgaacaaaggaaatgtagtgttcgaatcccttacggaataatgaatttttcacacgtaggcggtaataaagtgcggtcttttcttgcgagtgttcgatctgatggtggaagctctcaaacgaggtgtacaccctgccatgaccccggccgcgccccttaggagcacctttttcactgagccaactgtcaacccgatcaactgaaaagatgtcgtagtgatccggattatggtagctgacacagagcggatattccgtctgggttccatcaagatcaatcgcttcactgtcatgttggaacaggttcaccgcaggtgtgcaattcattcgcagtgtggtggagcggactttcacgtccggcggcaatgcctgagagaaatacaaattcagagagaattcactggcattcaagtgcggcggaaaatcgaccacaccattgacatcaaagaacaaaaagccttcggggaagcaaaaatactcttgcaggatccggtaacccatataggcgtttttcgggtacggcaagagggcatcatcgcgttcaaagcccactgggttaaagtcaaaatcaggcatcgggatggttatcccgttgacaaccagttcagcgcgttcgaaatagtggttaatccagaaatagagttgcgtgctggtgtagttgtcttcgcccagataaaagcgcaatttatccaattgcaggtcttgtaagttcaattccgctttggcggcaaagtgaacactcaaaatgccttgttcgttactgctgttcgccgagatctcccggatggacatggggaacaaccacacatcacggcacaacgtaaaagtacattgtggcccggcatgagcattactgttgataaacgcgctgcgctgaccattttgtgcgatggggatactcatcacttggctaccccgtttcaccagcgtcgcctcggtgaccacactttcatccggtgtgtactcgatgatggtcatgctcggtattggccgtaagtagttcggccacaacatattcagtaaaccatgagtcaattcagggaattgatcatcgattttttcacgcaggttgcccgttagaaaagcaaagccttccagcaaacgttcaacatccggatcagaaccttgctcagataaaaatgcagcgagatgaggccgttctattgcggcatcgcgtcctaattgccggaggtagtccagctcgtccctgaaatacttttcgaacgacattatgtttcctggttaaagcagtaacggcggttattgtctaactgaatgttgaactcaacgacatcacccatatcgtcgaaattaacacgagcgctaatatggaaactcagttgcagtgggtcgccatggttcagcaaggattgaaccgtaacggcagaaattcggggttcgtagttctcgatacaatccttaatggctttctcaatactttttcgaaaatcagatgaggtggcggtcgcatcattgaggtcgataaccccgagatcgaccgcactttgacaagcacctggacgagagttaaggacctcgttcaaatgcttttggattgaattcaatagctcacgcagacggccatcggaggaagagctagcgcccttcccctgtatgcggtcaaacaaactggcagaactccctcgatcccaattaagaagcgcggccatcgtcggttattccttatccaaacggccaaccagtgacagctcgaagctcgcccccatgtatttgaaatgcgggcgaacctgcatcgcaacctggtaccagcccggatcaccttcaacatccagtacctggatttgcgctgaacgcagaggacgacggctacgaacatccgttggtgggttttcttgatcggcaatgtactgcttgagccagatattgagctcgcgctccagatcctgtcgttctttccatgaaccaatctgctcgcgctggagcactttgatgtagtgcgcaaggcggttgatgataaacatgtacggcagttgcgtgcccaacttgtagttggtttctgccattttcccttcgcgggtattcgggaagacttttggtttttgcaccgaattcgccgagaagaatgcggcgttatcactgcctttacgcatggtaagggtgataaagccctcttccgccagttcaaactcacgacggtcagtgatcagaacttcggttgggattttggcctgaatctgccccatcgcttcatagagatgaaccgggagatcgtgaaccgtgccgccactttgcggcccaataatattcgggcaccaacggtacttggcgaagctgtcggtcaggcaggacgctagcaggaatgcggtgttgccccacaagaaatgctcgtgattccggctgacatcctcgtagtagttgaagtttttaatggggttttcaacggtcgagtaaggtaagcgcaacaggaaacgaggagtggtcaaaccaagataacgtgaatcttcagactcacgcagagcacgccatttggtgtgagccggcccttcaaatacagatttcagatctttaatcgcgggtaactcagtgaagctgctgatgccaaagaaatcaggggccacactggataagaagggggcatgtgccatcgcgccaacagcacttacgtattgcaagagcttcatgtcaggtgagctattgttgaacgcgtagttaccaatgatcgcggcagtgggttcaccaccgaattggccgtaccctgaggaataaacgtgtttgtagaagcctgactgaataatttctggcgagaactcaaaatcttccagcaactcttctttcgtcgcatgcatgatattgattttgatgttttcacggaaatcggtccgatccaccaacagcttcaatgagcgccatgaagattctatttcacggaattcgttagcatgtaggatctcgtccatctgagcactcaactttttgtcgagttcgatgatcatgcggtcaactaacagcttgttaatcggctcttcgttggttccggtatccagaatactgctaataaaagcggccacaccctgtttagcaatatcgtaaccatcgtttcccggtgccatacgggtttgtgacatgatttcgtcgagcaagaatgttgcactggcaggttctgccgctaaaacggtattttcttcatgtaaaggcatacgtagaattccctcttacccgagctattatttttgatgaagagctattacttttgatgaagagccattatttttgattaagaatgtccaattctttcagcaactgctcgcgcatatcttcattgccaagcaaatcctgtagacgagagcggaaagccgggatattccccaatggccctttcaatgccactagcgcttcccgtagttccagaatttttttgagctctggaacttttttcgccacattgtcaggcgagaaatcatcgagacccttgatcgacaaggcgaccggcatgtcttcttccccatcaccttcaaggcgattaggcacattgaaactcagactgatatttgcttcgttcatgactgagttgaagttattcttattgaccgaaacaacctgacgctcttcaattgatgtatcttcacgcacgcctttaagatcacccacaaccagcagattcagcggtaattcaatttctgcaacctggtcgccagtattcggcacatacttgatgttaatcctttcttttggggcaacactgctttgcttatttttactcattacacgtccttttaatctctaataaggggtgtcagccaatatgtcacccacagcagaaagggaggttcttatattaatctgactcaactgtgcgcatagttaactattttcaaggtaaatgtctataatcttttctttatattaaaacatgagtggcatttttattgcgatataatgattctatctatgatcataaaaaataatttcctttaaaaattaaaatcgtatgaaaacattattttacgcaaacacagcattcgatatcacgatcagttttgtaacatttgcgaattaaatcagcaaatatcgcggcataatatgctggttatacaaatattataactttttcgtccgtgaacatgcgggctaatttatacgaaacttggcactgataaaaaagctgcttatagtgataatcagaaagtgaagtggtggagcgagttacattcaacgctgacagatatgtccagcagaagtgactaacctttgatcaaaatcaaataaactatcaaggatattaaaaatgccaactccagcttatatctctatcacagggaaaacgcagggcaatattaccgcaggtgctttcactgctgaatccgtcggtaatatctatgttcaaggtcatgaagacgaaatgttggtacaggagtttgagcacattgtgacggtgcctaccgaccctcaatccggccagccttccggccaacgtgcgcacaaaccattgcgtttcactgttgcgtacaacaaagccgttccattgctgtataacgcattagcctctggtgaaatgctgccaacagtggaattgaagtggtaccgcacctcgattgaaggcaaacaagagcatttcttcacgactaaactggaagatgccaccattatcgacatcgattgtagaatgccgcattgccaggattccaccaaggctgagtttactcaattagtccgtgtatcactggcataccgcaagattaactgggatcacaccaccgcgggcacctctggtgctgatgactggcgtgcgccgatcgaagcgtaatattgtatttcttcagcagccaatgaggttattggctgctggtttttactgatggtttttagtgtatttaacccgcctgatattccttttatcttcatcgcgcgcttaaccgatattgagtgcaattcaatgtgtcgccgccagggatatattaacgccacaaaataatctccgtagttaaatacccctcatttaccgtatagttcatacacgcgatatcgccgcattttatatatgagtttttataaaacactcggttagaataatatattaatagcagagcatcatttccaaaattgatatacacagtgactattttggatttatttttaacaaacttattacaaataagatgtgtttttaattcgcgttccacttgcttaattaaagtgccatcggaaaacaacagcaataaattaggaaaattcatcgcaaattaaaggaaatttcctacaggattttttttcgacaacaagcgaggatccagtcatatttaatgtcatgctatgacaaaaaaagtggctatcattggcgtggttaatttgtttattgatgtcactcatttgtgtattaataaatactgcaagtctttcagtctctgctcacagataattccaatcgaacgcaaaccgaatctcaacgttatattaaataaaaaagaatgagggtgaatgcggccgtcatccacaaaccaaggcgtagcgagctaagtcagattgagtgcgtccagcgcgcagcacccggagcgtacacatagtacgtgaagagagtgagtacgtgaagagagcgagcactgcacaatctcagtatgacgacgcgcagtagccgcttataagaaccaaacgaaaaaaggtgcgccaaggcgcaccaaccatccagccatatttggcagtgccgggatttaacccttgccttttacactaccaataaaggtttttcgggctgaagttgagcccaaatgttccgcttcgttcaacaatttcagcgccttatcgacatcaccggctttcaccgcgtctttaatcgcctggttgaagtagttttccgtctcacccaacatcggtgctgcaggtttcgccggttctgattgtgccgcagccacgggttgaatactgctgcccaccacgaccggagccgaggtcggtgccgactggatcaagccaatcataatattgcccatgccttgctcagacgttaccttaattcttaaagtccctgttggggagtgattgacaatggggtccgggatatctgggacggcattacccacaccttgtgcgtacgcttttgccggatcgagcaattgtgtggttttcttcaaatcatcgcgagtggtatagaccagcaggtaaatttgtttctggcccaacgctggcgtcaatttcatcacgccttgcaggcgatcattgatcatgatgcccgctttttcataggtgaaatagctggacgggtaataagccgctggccgcatttgctcatccaacaccaatacgctcggtgtaaagagctgcttatccgtgagcaaactgctgagcgtgacttccaatgaaccgcgatccgcaggcaaggcaaaagcggctaccgcgccttcaacctcaccctgagaaatatgcgggctgcccgcagtaagttgaatatcttgcgtcaccggtggcaccaaaggctgccatggcaactgctgtaatgtggtggtactgatcgttggcgcaatagagacattcgccggagaaatggttgatgcggcctgtactgccagaggtgcagtgccccctaaagccagtaccagacagagtgacagcagattctttttcattgttataccctcatacattgagcgtcagcgctaacggtgcccaggcaaggtcggcaaagttaaccaatctacccgtcatactccaagctgcatgtagcgttggccgccttcctgcaactcaaattattttgggtatacatcttgtggtcagtaggatgcgggccacagcccgcacacccgtaaaacggttaagacatcaagataacgtacagccgcccgcagacggctgaagaatcgctgttaccaccaggcttcgaattgcgcaccgaaggtgacttcattgttcttaccacggctgttggtaccaatagtgccgtcttgtgctacgccggttgtatcgctatagccccacttctcatcccagttggcataagttgcgaagacacgaattgccggacgtgaccaaatgctatcacctgcctgccattgttgggccagagtcagtttgtattgaccgttacgttcaccggtatgttgtgatttaacgttgtcgtagcctgcttccagcaacgtactcatgataggtgtccatttgtacatcggacgtacacctacgctgtaccatgtgttgccgttattgttatccaaatcaatatcttggtataacgcgacatacatcatgtcccacttctcagccagattgatggcaccgtggtcaataacacgcaataagtggccattattatttactgacgtaccttgcgagtgaccggtgttataggacgtcatcgagtcggtagcatattgcaccacgaacttgttgaagccacccatcaggctttgggtatgctcagcggtcagcatcacaccatctttagaggcatttggtgctaacgagtaaccttcttgagtatcggcgcggccataatcaacacctaactccaatgaaccgccggggttagtttctaaaccggccaaacgcacgtcgtatacgttgttaatcgtatattttgcattttcacgttggttatcgatccaagcgcttgagccacccgattctgagttacgggttgcagcaaccgataacttaccaaagcccagatcgatagtttcaagaccggcacctgggcctgaaatatcccagtagtagaagtcaatcatatggacgtcatgacgttgatagaaacgcttaccggcccagatagtggagcccggtaatgattcgatcaggtttttaccctgcacattggcttcacggaaagccggatcagtggattcccagtcatcacgctgtgaaacggaataggcgacgttggtatcgagatagaagctcttatcgccttctttccacaattcctggcctaatttaagttccgcataggtttcacactcgttgcccagacggtatttactttgagcacctgtagtttggaaacattgttgttcaccaccgcttgccgtccagccaatcccggaacgcgcataaccatggaaatcaaccgccatggcctgagtggagaggacaccagcggcaacagccagtgctattggtaacttgcgcagagtaatcatcagtaatctcctgttatatttgcctgtcggcatgcgtgctttcattctctgtaaccaggcgtcgccgtaactagacgcccagttcttggtacagccgcttacatgcagtgccatcctcacggaagaggtgacaccgatgcggtggcagaccgatggagaatgttgcaccttcttctaccaacaccacgtcgttctggcggtagaccaggttctggcgtattgctgggatttggatatgaatttgagtctcattacccaactgctctaccacctgaatctcgccttccaacgtgacttcagaggcgctacttggcagcagatgttctgggcggatccccaaagacatattggcgccgacctgaacctgatcgccttccaccggcagccatacccgctgatggttagggagttcgatctgtacttgacgaggttcagcggccgtgactttaaccggtaagaaattcatttttggcgagccgataaagcccgcgacaaagcggttggctgggtagtgatacagctccagcggcttaccgacctgagcgatattgccggcgtccaacaccacaattttgtcggccagcgtcatggcttccacttggtcatgggtgacgtagatcatggtgcgttccaagcgcttatgcagacgagaaatctcgattcgcatctgcacccgcaatgcggcatccaggttggaaagcggttcatccaacaggaaaacatctggctcggagaccaaggtacggccaatcgccactcgctgacgctgaccaccggataaggcttttggccgtcggtccaacaagtgagccagttgcagcacctctgcgacctgattcacccgctggtaaatttctgctttctttacccccgccaatttcaggccgaaggacatgttttctgccactgacaagtggggataaagtgcataggattgaaacaccatgccaatgccgcgctcagagggcggcacttcattcatgcgtttgccaccaatcaacaactcacccgaggtaatgtcctcaagaccggcaatcatccgtagcagcgtcgatttcccgcaacctgatgggccaacaaacaccacaaactcaccgtcatcgatctccaggttgatgtctctggaaatcacagcctcaccaaaggccttataaacgctgctcagcgttacattagccatgcgttactcctttgcttgcgcaaacaacttttcatatgaatctgaatgaagaaaaacagtggaagcaaaccccggcatgacccattgattacccccagtgccctgatgactctctcgctgcgcgccgtgccgccaagccagtggcaaggttgccccggacggcgtcgcggcctgagtatagggctgcacgttgaacaacgcctcaacatactgatccaacagggtaataatgagtcgcacaccccattcaaccctcgataatcccccacgccattacccttgccatcgcggaaactcaccggatgaatgcggtacaacgctgggttaggaatcgaacgtgctgacaacattattcctggtcctacaagctgggagttaaactcgatgtggctgatattgcgggagtgtcactattcggtaatcatccgtaacaaagtttttcatgggggaggggatgggaggatgagagaacgaccactcttggcagaagttccgtgacaaagacaaattcgtgatccgctctgcaaatttcgacctacattattgtgcctaacaccacaaaacaggctgcagtgttaactgagtcacaataacccgtgggggggcgtagagggggggaggatgaggcagagtccctttgtgacccactatgtcagcgtaataaccaggtcagcgtaataaaggtaataaccaggctagcgtcatcattggccacgctgccacgcccccttctacttcgtgattcatggcgatagcagtctgaaaattcgcagctaatggctcacaagaaagtcggtacccacaaaattggataaaaggattggattatgactcgcagcttcacgaaatccggcattggtaagaccgcacgtgttttggctctttcggcgttaaccacgctggtgctctcttcctctgcttttgccaaaattgaagaaggtaaactggttatctggatcaatggagataaaggttataacggattggcagaggtcggtaagaaatttgagaaagataccggcatcaaagtgaccatcgagcatccagataaattggaagaaaaattcccacaagtcgccgcaaccggtgatggcccggacattatcttctgggcccatgaccgttttggtggctacgcacagtcaggtttactggctgaactgaccccatcgaaagccttccaggaaaaattgttcccgttcacttgggatgccgttcgctttaatggcaagctgattggttaccctgttgcagttgaagcgctgtcactgatttacaacaaagacctggtgaaagaagcaccaaaaacgtgggaagagatccctgcactggataaaacactgcgtgctaatggcaaaagcgccattatgtggaacctacaagaaccgtacttcacttggcccgttatcgccgctgatggcggttatgcattcaagtttgaaaacggggtttatgatgcgaagaacgtgggcgtaaataatgcgggtgcccaagctggcctacaatttattgtcgatctcgttaagaataaacacatcaatgccgatactgattactccatcgcagaagcagcctttaataaaggtgaaaccgcgatgaccattaatggcccatgggcatggtccaatatcgataagagtaaaattaattacggcgtaaccctgctgccaaccttccatggccagccatctaaacccttcgtcggtgtactgaccgccggtattaacgcagcgagtccaaataaagaactggcaacggaattcctggaaaactatctgatcaccgaccaaggcctggctgaggtcaacaaagataaaccactgggtgccgtagcgctgaaatcattccaggagcaactggcaaaagatccgcggattgcagcaacaatggataacgccaccaacggcgaaatcatgccaaacattccgcaaatggcagccttctggtatgccacccgtagtgcggtactgaacgccatcactgggcgtcaaaccgttgaagcggcactgaacgatgcggcaacccgtatcacgaagtaactgtctactctgagaaaggggcacggttcgccgtgcctcgacagaatttgccataacgcgatccaatgttaagcacagctcaacgttaaacacgacccaacgttaaacacggctcaactttaagcacaacttattaagttcaagcacaacttaacttcaagcacaaaaagtatgaaagggaacattatgcagttatcccacaccgagcttcaaagccgaaaaaagaaaatcgcctggtggcagagtgatgcgcttaaatggttggttatcagcctgttaagcctcttcacctgttatttgatcgtgttgatgtatgctcaaggtgaatatctttttgccatcgtgacgctgattttggtgagtttagggctgtatgtgtttgccaaccgccgcgcttatgcctggcgctatgtttaccccggcgtggccggtatggggctgtttgttctcttccccttaatttgtactatcgccatcgcctttactaactacagcagtaccaaccaattaaccttcgaacgtgctcaatccgtcttgctggatcggcagttccagaccggtaaaacatttacctttggtctctatcccagcgataaccaatggcgtttacagcttaccaacccagacgacggtagcctgttcatctctgaacccttcagttttgaggccacgggtgagcaaaaagtgatggtcgccccaaccaatacggcacaaacgagtgaaccggcatcactgcggattattacccagagtcgtcaggcgctaagtggcttagtggctatcctgcctgatggtgctgaactgcgtatgagttcattacgtcaattttccggcaccaagccgctctatactctgggtgccgatggtaaagaactgattaatcagcaaaccggcgtgaaatattggccgaatcctaataccgggttctatcaagcggtcaacgctgatggacagtgggaaaatgaaaagcttagccccggctttaccgtatctatcggctggaaaaacttcctgcgggtactgcacgacgaagggattcaaaagccgttcatctcgatctttatctggactatcctcttctcggtaatgagcgtgacctttacggtagctgtcggcatggtgctggcatgtgtggtgcaatgggattcgctgaaaggtaaagcgatctatcgggtgatgctgatcctgccctatgcggtaccgtcgtttatctctattctgattttcaaagggttatttaaccaaagtttcggtgaaatcaacctgatgctcagccatttatttggcatcaaacccgcctggttcagtgatcctatcaccgccaaaagcatgattttaatcgtgaatacctggctcggttatccctacatgatgattttgtgcatggggctgttgaaagcgatccctgacgacttgtatgaggcatcggcaatggatggcgcagggccattccagaactttttccgcatcacgtttccgttactgattaagccactgacaccgctgatgattgccagttttgcctttaactttaataacttcgtgctaatccagctattgaccaacgggggacccgatatgattggtaccagcaccccagcggggtataccgatttgctggttaactatacctatcgtgtcgcctttgaaggcgaaggcgggcaggacttcggtttggcagccgctatcgcaaccctgattttcattttggtaggcgcactcgcgatactgaatttgaaagccagcaaaatgaattttgactaaggaggagatgcagatggctatggttcaacctaaatcccagcgtttgcgtctattgggcacgcattttctgatgttgtgctttatcgcgctgatcatgttcccgctactgatggtgatcgccatttcactgcggcccggtaacttcgccacaggtagcctgatcccagatcaaatctcgtgggaacactggaaattggcgctcggtatgagtgtgacccatgctgacggtagcgtaacccccccaccgttcccggtgatgttgtggttatggaactcaattaagatcgccttgattaccgccatgggtattgtcgccctgtccaccacctgtgcttacgcctttgcccgtatgcgtttccgtggtaaaagcgccttgctgaaaggcatgttgatcttccaaatgtttcccgcggtactgtcattggtggcgttgtatgccttgtttgaccgtatcgggcaatatatgccgttcatcgggttaaatacccatggcggggtcattttcgcctacatgggcggtatcgccctacacgtctggaccatcaaaggttatttcgaaaccattgataactcattggaagaagcggcagcattggatggtgcaaccccatggcaagccttccggctggtgctattgccgctgtcggtgcccattttagccgtggtgtttattctgtcgtttattgcggccataaccgaagtccctgtcgcctccctgttgctgcgagatgtgaacagctacactctggcagtcggtatgcagcagtatcttaacccgcaaaactatctgtggggtgactttgccgccgccgctgtgttatcggccattccgatcaccaccgtcttcctgctcgcacaacgctggctggtaggtggattaacggcaggtggtgtgaaaggttaagcattaaagatttcatcattcaataccctaactctttggatgagcagggtattttcccctctggtactgtgtctttagggcggccttaatggccgccatttttatgtttatcacccgccatcgccccaaagataagaaggggttattcgcgctttaaccgctcagtattcgccagatacaaggtcacgaccaagactaaaatggaaccggaatagatcagtgtatcaataggattttcatgatccacaatgatcaaacggataatcgcggtaatcccgatataaataaaatagcgtaacgggaagtggtagccggactcaaaatacttaacaatcagtgcaataaattcaaaatagaggaaataaatgactatcccttcaatcagcatgtaggaggaggtttcctgattactcaggaacaagactttccccagatgaatggtttccttcaccaaaaaaaccaccaaaatagcggctaacataatcaatcctacattcagtaaacgttgcaaatttttagcgatccactgagaacgcgaatttttagccataaatactcccaaggaaagtaggtgaaacagcctgagcctatcatagccatgttgcactcaagccaaaaaaaaggccccttacagaataagaggcctaataaagtacagatcaaagagcttaagagcctgttagcttaacgccagttcttgaaacggttaatcaacgcattggttgaactgtcatgactggtcacttcttggtcatctgccagttctggcaggatacggttagccagttgtttacccagttcgacaccccattggtcgaaggtgtagatattcagaataaccccttgggtgaagattttgtgttcatacaaggcaatcagcgcccccaagctgaacggggtaatttcgcgcagcaaaatggagttagttgggcggttaccctcgaagactttgaacggcgctacgtgcgcgacttgttcaggggttttacccgctgccgcaaactccgcttcaacgtcttccagggatttaccgaaagccaatgcttctgtctgtgcaaagaagttagacaacagcttcgcgtggtgatcgcttaatgggttatggctgatcgccggtgcgataaaatcacacgggatcagtttggtgccttggtgaatcaactgataaaacgcatgctggccgttagtacccggctcgccccagataatcgggccagtttggtaatcaaccggatgaccgttacgatcaacatatttaccattcgactccatgttaccctgctggaagtaagccgggaaacgatgcatatattggtcgtaaggcaggatagcttccgtttctgcaccaaagaagttgttgtaccagataccaatcagtgccaacaggacaggcaggttcttctctgccggtgtttcggcaaaatgcttatccatggcatgtgcgccactgagcagttgttcgaagtgttcaaaaccaaccgacaaggcgatagataaaccaatagcagaccatagcgagtaacggccaccaacccaatcccagaactcaaacatattattggtatcaataccaaactcaccaacggctttggcattggtcgataaagccgcaaagtgcttggcaacgtgcgccgggtcaccggcggcagacaggaaccaatcacgcgcgctgtgagcgttggtcatggtttcttgcgtggtgaaggtttttgatgccaccaggaacagcgtggtttccgggttcaggggtttcaacgcttcggcaatatgagtgccatcgacgttagaaacaaaatgcatattcaggtgatttttatacggacgtaacgcttcggtcaccatgtaagggccgaggtctgaccccccgataccaatattgactacatcggtaatcgctttgccggtatagcctttccagtcaccgctaatcacacggtcacagaactgtttcattttggccagaaccgcattcacttctggcatcacatctttgccatccaccacaattggggtgttactgcggttacgcagagcaatatgcaataccgcacggtcttctgtgcggttaattttctcaccagaaaacatggattttattgcaccagccagatcggtctctttcgccagatcctgcaatttttccaaggtttcgctggtaatacggttttttgagaaatccaccagcatttgatcgtcaaaagtcgcagagaaccggttaaaacgctggtcgtccttggcaaacagactgctgattgtgacatctttcatctgttcaaagtgttgctgtaacgctttccaggcagcggtttgactaggattgatatttttcatagcggcgctcttctaggcttaaggattaatgaaacgaatacattgattgtatcctgttaccctgtgattgagatctcttttcttgcgataggtattatctctcgaaacaacgcttgatctgtttcctatttctcgccatacgtcggttcatcttaagacgttcatcattattttaatgacgttcaattagagtagccgctcatattcaggccagtatccaatcaatttagtgatatgacggagcgtattattaaagatgaaaatacctcatagccatttcattgacagaaagtggataacccgttatttccttgtacagagaaaaatacagatgcccccaagatggcatcactgacacgaggtttttagatgattcaagtcgccccccaacagacccgcgatgcaccttctgcgactgtcgtcgccaaatttggcggcaccagcgtggccagttttgatgccatgagtcgtagcgccgatgtggttttatcgaacccggacgttcgtttggtgatcctttctgcgtctgccggtatcaccaatctgttggttgcccttgctgatggcagtgagccagaaaaacgtgcagaccatctggaggaaattcgccatattcaatacgatattattgccagactcactgattcgacggtgatccgcgaagaaattgaccgcatgttggaaaacattgccatgctgtctgaggcggccagtctggcgacctccccggccctgaccgatgagctggtcagccacggtgaattaatgtccaccctgctatttgtcgagctgttacgccaacgtcaggttgccgtggaatggtttgatgtgcgaaaagtcatgcgaaccaatgaccgttttggccgcgcagagccagatacctcggccttggctgaactggcccaaacactgctggcaccgcgtattgaagatgccattgtggtcacacaaggttttatcggcagcgaaggcaaaggccgaaccaccactctgggccgtggtggcagtgattacaccgccgcattgttaggtgaagcactgaatgtcagccgtatcgatatctggaccgatgtgccggggatatatacgactgacccgcgtgtcgtcccggcagcaaaacgtatcgataaaatcgcctttgaagaagcggccgaaatggcaacctttggggcgaaaatcctgcacccggccactctgctaccggcagtacgcagtgatatcccggtgtttgtcggctccagtaaagatcctgcggctggcggcaccttggtctgtaacgaaacctacaacccgccgctgttccgtgctctggcactacgccgtaagcagacgctgttaactttgcacagcttaaatatgttgcatgcgcgcggttttctggcggaagtgtttaatattctggcgcgccacagtatctccgtggatttaatcaccacgtctgaagtgagtgtcgcgttaacattggataccaccggttcaacgtctaccggtgatagcctgctgaccacctcgttattgacggaactctcttccctgtgccgggttgaagtggaagaagatctggcgttggtggccattatcggcaacaacctgtctcaggcttgcggcgtcggtaaagaggtatttggtgtcttggatccgttcaatattcgtatgatttgttacggtgccagcagccataatctgtgtttcctggtaccgggtaatgacgctgacaaagtcgtgcaaacgctacattacaatttatttgaataaaacagatgttatttgaataaaagagatgttatttgaataagacagtttatttgagtaagataacttatttgtgtaagagagcacattaacacattaatttatctgctaattaaacctgactggttcacaccaaaccggatgatttcaaacgtgtactttccctgctggccggctactggtcaggtaaaccggttaaaacagataaaaaataattaaacctcagaaaaatgcctgagatcatcgggcattcactgctaacacgaccttcatctctgacactgacatttatgcccctcacccgtaaacacaaaatagaaaacagcaatatccgtgattaaccttaatttgctttaaataacgcaaaaatcactcactcttcgcaaaatttatattcatatttcactgttatattttacttcctgccaacaacttaattcccgttgtttatccgtcgttctctattgttcagggacggtaattgtgctgcccgtcaatttgactcagggacagaaagagctgcgcctgcaaataaatttgttcggtcagtctatttctcaatcagatattatgattagaaaacgtactgcgttatggcttgtactcagtactggcgctcaagccgagacgcctttggccatagagaccccatcttccattaatgaatctcgccagtcactacaaaataatgccaaagaaattaatcagctagtagaagaaaaacgccaccaacagatcacacaacacaacaccggacaaagtgaattatctcgtccggccccccccccctgcaccggtgttacccgaagatacgcagtgcctacccattaatggcgtttatattcaggggatcaccttattaacagaggatgatttaagtgaattaagtgcgatccctgaacaatgtattcatcctgataatattaaccttctgacccgtgaactcactcatatctatatggataaagggtatatcacggcgcggattcaatttattccaccagatgctgacggaaaattaggtctggatattaccgaagggtttgtcgaagcgattgatagcacggacaccgggttagatggcgagacggtattcccgaatatgatcggcaagccgctcaatattactcgccttgatcaaggactggaccaggcaaaccgtttgccctcaaataaagtcaccgtcgatattctgcccggaacactacccggtggttctattcttaaactgcataatacaccgtcaacgccctggcatttgaccacctcgatggacaattacggtaataaaaataccggtaaatggctaagtcgcaacgccttatctttcgataatccgttgggcttatcggattccgtcagtatcaatatcagcaataccgttgatcgcccccaacataattatagccgtgcttactcaatgttttattcggtcccttacggtgccttgacctttagtggctttggtagttatgccgaataccgttatccaatgaaattgcagtttaatacagccaagttacatggagaaacacagcaacacggtttacgggcagattatgttttctatcgcgatcaaagccagattaatgggctaagtgcgcaattaacctataaacgggccagtaattatctgaatgaagaaaaaattgctatcagcagcccgacgctaacaatctttgaattaggccttaatcacctgcacgtcctgcccatgggcttattcaatatcaatgtcagccttgagcagggcttgccttggctgggcgcggagcgctcaaatggcccattagcgaactatcaagatagccaattcactaaagctaagacctcaattacctccaatcactactttgcactgtttgatgatacctatctgttcagcaatcaattttatggccagtacacccgtgaccggttacccggcgtggaatggctcagcatcactgacagcagtgccatccgtggctttagccgcaataccttatccgccgaccaaggctggtatttacaaaacaccctctcccgtcgtttcaccttgggtgacgccacgctaacccctcgcgtagggcttgatacgggccgtctccagcaaaaaccacaggggtgggtcagcgctatggggctaagcgctggcgtcagccttaattaccagaatgccaccttggatatagaggccagccgtggccgcttactctccggcccatcgaagattaacgatccaacacaaattctggcgcgtttttcttatcgcttttaatgcaatttttccttgagaacaccttgttactcagatcaggaaatatcaccccaaaatggagatgtaaaaatgaaaagacacacctttaagctctcgcccgctgggaaactggcggcggcggtaaccattatttcggtttctgttgccacctgttatgccgccggtattgtcggagcgggcgattctgcacataaacctgatgttagctcggtaaatggcacatcggtgattaatatcgtggaaccgtcagcctctggcttatcacataaccaatttcaggattttaatgttgacgaaaagggagcggtactgaataacgcgaccagtgcaggtaactcaatacttgccgggcagttagccgctaaccaaaatttaaacggtcaagcggccagtattattcttaatgaagtcatcagccgtaatccttctctgttattgggccaacaagaaatttttggtatgacggcggattatattctggccaacccaaatggcatcacctgtaatggctgtggttttatgaataccaaccgcgagtcactggtcgtgggtaatcccttgattgaacaaggatcgctgaagggttttgaaactttcaataacaataattggttgataattcaagataaggggctaactgctaataaaatattggatctgatcgcacccagaattgaggtcacaggtatggtcacctcaacggaagccattaatgccttatcaggtaataaccaaatttcaactgatgggcaaatattagagtctcgccaagaagatcatccaaatcgtccaaccagtttggggggatggtttagcagtttgttttcaagtgaaagtgaagaatctattgatggtaaatatcttggcagtatgcaatcaggccggattaatttagtcagcactcgggaaggcagtggggtaaaaattgccgggagtctaaacggtagcgaagaaataaacgccactatcaaaggaaagctgcaattagaagccgccaaattagggggtaatgatatcaacatcaacgccaatagcatccaggcattcggtaatcttcataaaaatgaagacaatgggggtgttacgcagagtctggaacgcactcagttaaaaggcaaaaatattgctatcgttgccaataaaaagaatcagctttccgcagtaaaaatcgatgctgacaatgtgacgttgagaggaggtgaattggtattggatgagagaatcctcaccaagacagaacaagaatcttcatcagacggtggaaatggggtgctgggcctaggtaagtggaattggtctgaaaataaagaggagaaacaacaaaccagtattggcaccaccattacagcgaaaaataatgcctctcttgaatcaactcaagatgatattaaactgtcggctgccacaataaccgcgggtaaaaatcttgccatcaaagccaaaaaagatttacacatagacggtgttattgaagagaattcaattcacgaccacggccataattataaacatatggtcaaagatgaatcttggaataataaaaccaccaaacaaacactcaataaaaccacacttgaggccggtaagaatttgggcctcaccgcagaaaataaaatcacgactcagggaatcaaagcttctgcggggggtgacgtcgtaatcgatgccaacgacgttaagattggggtacaaaaaaccagtaatcaggaaacaaccgacggtaaacatgaaagaaacttgggactcggtggtgtcgatcacaataataacgataagtatgcggaaaccagccatagctcagaaataaccgctgacggtaatatactcatcagcgtgaaagatgacgttgctattactggcagtaaagtaaaagcaactaaagatggttttgttcaagctaaagagggtgggatcaaaatcgataacgccatcagtaccacaaccaataaagttgatgagcgtacgggggtagcatttgatattaccggcagttccaaaaaagccaataacagtgaagaaaaatctaccggtagcgaagtcgtctctgaagcaaacctgaaaatcatcagtaaaaaagatgtcgatgtgattggcagcttggtaaaaagcgccggtgaattaggcattgagaccttaggcgatatcaatgtcgccgctgcgcaggaaaaacaaaagatcgatgaacaaaaaaccctactgacaattgatggttttaccagtgatgacggtaaaaatcagtatcaagcggggctaaaagtggaacacaccagcgagagtgaaaaaacggagaaagtgataaatcacggctctactctcgaggggggcaccgtcaaactggaggcagacaaagatgtgacattcactgggtcacaactcaataccaccaaaggcgatgcggatatcactgctgaaaacgtctcttttgtcgctgcacaagacaccaccaccagcaataaagaaaaagagaccgtgggtgtgaatgctcactataccggtgggatggataaagcgggtagcggtgcgggggtgagttatgaagagacgaagacggacagcgagaaatcaactgcggtcgtttcccatactgacgtgaaaggcgatctgaatctcaacgccaaacaagagataactaaccaaggcaccgatcataacgtcgaaggcagttacgcggcgaatgcaactaacgttaataatttagccgcagaaaacagtgaaaccaccaccacaaccaccaacactgtcgatgttaaatatggtggtaatatcgcttatgacggtgttactcgtcctgtcgaaaagacgatagaaagtggtaaaaaattggatgttggtggcgttattgaaaacgtaggaaatgtcgcgccagattcagtcaatgccggcgtagacctctccgttaatgttggcgaaaaagagaataaatccagtaattctcaagcggtagtgacatcaataaaaagtggtgatatcagcatcacagcaaaagaggatgtcaaggatcaaggaactcactaccaagctgacaaaggtggaataaagattgatgctgccaaccacacttttgaatctgcggttaatcgtgctgaagaatcagaaaaagtcgtatcgggcggcgtagatatgcgaatttataccactacgggcgaagacatcaatgttgatgcaaaaggtaagggtgaaaataaacagcaagaggttaaggccgagcaggctcaaactggcagcatgaaagctgttggcgatattattatcaacgtacaagaaaacgcccgttatcaagggactgatcttgattctggtgatggaaaaatcgctatcacagcaggcgaagagattaaatttgaacaagcaaccagccacctcagtgaaaaccacaataagattgatgcaaacgccaaagcaaacttcggtactaagccgaacagtaaagactttggcggcggcttgggcggcggccatagtcaaggcagcaccagtgccgatattgcccaagtcagccatctacacggtaagcaaggcatcgagctgaacgctggaaaagatttaacactgcaaggtaccgagtttggcagtaaaaatgccgctaccggtgatgttcaacttaccgccggtggaaaagtagacttccaagcggcacagtcacaaagttctaagcaagatatgacctggtctgccagcgtcaaggcaggaaaaagcaaaagtaacagcaccagtgaaaatgatgatggcacaaaaacgcatactaacaacaaagggttcagcgcaggagcagaagccaacgttaaaaacactgatgagaccagtcttacacatcagggcggcattattaacagtaatggcgcggtgaccattaaggcagacggtaaagatcagcaagccatccatctgcaaaataccaacatcaccagtcaagagaccattctgaacgcggataatggcgggatcgtaatggaatcggctcaggataaagagcacaaaaataactggaatgttaacaccaacctcaatggcagccagaaaaacaccattaaaagcgatgatcaaggtgttgtagataaagatagcgccaagaaaatccataatgcggccatcaaactcgatggcggtgttgataaactggactctgtgacgcaacaaaacacccatatcaacagtgataaggtgaccctgaacagcgctaaaaataccgaattggcaggcgcagtactccaggctaaccagattagtgggcaaatcggtggggatctaaacgtcattagccgcgaaaacagactcaataaagtcaatgtttctgccgcacttggcggcagccacagcaatgcaaaacaagacagtttgatcagccaggtagcgaatgccagcccaattatgtctgataaaatcaagaataaactggaagagaaatctaccaagatcttcgacaaagtcgaaaataaattcaacaccttaggaaaagaaaaggacgatagcgtccagaccatcagctataccaaagacggtcaaacagtgaagatcagcgaagccgatgagaagaaggaaaccaaagataaatggtggcagaaaggggctaaatctgtcggtaagaaaatcaaaagcgcggtacaggatgaacaagtcgtcgggggtaacggcagcgtcaaagcgaacgtagaggttgtcgagagccaaggggttgaggagcaatcagctatccggggtacacagaatgtggatctgaccgttaagggtaaaactgacctggttggcgggaagatatccagtaaaaattcggatgtgaagctaaaaaccaatgggttagagacgcaggatatcaacgggaaatataccgaagggggcgcacgattgaacgcttcttcatcggttatggatatgattagcgatggcgctaaggatgtaatggatggcaaggcaccgctggtcagtggacatggtaaatctgaacagaaaaatgcaacgggtggtatcaccagagaatgatcaatccattaattaaactgtaatatcgaaggggataaaccaatcacggtttatccccctcgttagatcaacattatctcgcctttaaacgcacatcaatccgcatcgtaacccagattaggggctagccagcgttcaacttcggcagtgggcatccctttacgggcggcataatcctcaacctgatcacgctgaatttgtgctacggcaaaatatttgctgtctgggtggctgaaataccaacccgataccgaagcccccggccacatggcgtaggattcggtcagtttcataccggtgtgggtttcgacatccaacaactgccaaatttggcctttctcggtgtgctccgggcaagcgggatagcccggtgccgggcggatcccctgataattttcgcgcaccaactcttcgttgctcagattttcgttcggtgcaaaaccccaatacactttacgtactcgctcatgcagatactcggcaaaggcttcggccagacggtctgataatgccttaatcatgattttattgtagtcatcatgttgcgcatcataagcatcggccaacgcgtcctcttccaagccaccggtcaccgcaaacgcaccaaaataatcggctttaccactggatttaggcgcgacatagtcagctaaacagtagttcgggaagtcggttttttcggtctgttggcgtaaatgatagctgatggccagtacctcatctcgccgctcatcacggtaaatttcgatatcatcgccgacgctgttagccgggaacagaccaaccacgccttttggatgcagcagatcctcggcggacagtttatccaacaaagcattggcgtcggcgagcaggcgcttggcctcctcccccaccacctcatcttccaaaatgcgcggatacttgcctgccaacgaccaggtcataaagaatggcgtccagtcgatatagttgcgcagagtttcaatactggcctccaccacctgtacccccaatttatgggccactggcggagtgtagttctcccaatcaatcaccgttgggttattccgtgcagcctgcaaactgaccggcggggtgcgcggttttttacgggcatgttggatacgtacagtctcatattctttgcgggtttttgccacaaatgcctcccgttgcgtatccgatagcaacgcggataccacgcccacactgcgcgaggcgttagagacatacgtggtggaaccgctataattttgctcaatcttgaccgcggtgtgagctttggatgtcgttgcgccaccaatgagcaacggcagcgtaaagccttggcgctccatctctttcgccacgttaaccatctcgtccagcgacggggtaatcagaccagacaggccgataatatccaccttctcttcccgtgcagtgcgcagaattttttccgtcggcaccatcacgcctagatcgatgatttcatagttattacactgcaaaaccacacccacgatgttcttgccgatatcatgcacatcgcctttgacggttgctaataagattttaccggcggtggtacccttctgcttactggcttcaatataaggttcgagataggccaccgcctgtttcattaccctggctgattttacaacctgtggcaggaacatttttccttcaccaaacaagtcaccaaccacattcatcccagacattaacggcccttcaatcacttcaattggccgatctgcctgctggcgcgcttcttcggtatccagctcaataaattcagtaatgccttttaccagcgaatactccaaccgtttcaccaccggccaaccacgccattctgcttgctggatcgcgacctcgccacttttactgtcacggtatttttctgctaaatccagcaggcgctcagtactgtcatcacggcggttgaggatcacatcctcgaccgcatcacgtaattcatcagacaggtcgtcataaatcgccaattgaccggcgttaacaatccccatatccatgccattgcgaatagcgtaatagaggaacactgcatgaatggcttcacgtactggatcattccctcggaaagagaaggaaacgttggagacaccgccagaaatcagcgcgtgaggcaactcggctttgatatcggcacaggcttcaataaaatcgacggcataattgttatgctcttcaatccccgtcgctacggcaaaaatattcggatcgaagataatatcttctggtgggaaaccgacggtttccgtcaatattttatacgcacggcggcaaatctcgattttgcgtgcgcgggtatcggcttgcccggtttcatcaaaggccatgaccaccatggcggcaccataacggcgtaccagtttggcgtgatgaataaaggcatcaacgccctctttcatcgaaatggagttcacgatgcctttgccttgaatacatttcaggcctttttcaatcacatcccaccttgaggagtcgatcataatcggcaccctggcaatatcaggctccccggcaatcagattaaggaaacgcaccatggccgcttcggcatccaacatgccttcgtccatgttgatatcgatgatctgcgcgccgctttcgacctgttggcgggcaacatccagcgcctctccgtacttctcttcttttatcagccgtttaaagcgtgccgaacccgtgacgttggtccgctcaccgacgttcacaaacagggtattggcatcgatagtcagtggctccagcccggccaaacggcaggcaaccggaatatcaggcaacgggcgcggaggcaccccagcgacagcgttgaccatcgccgcaatatgccggggtgtggtaccgcagcaaccgccgacaatattcaaaaatccggcacgtgcccactcgccaatctgctcagccatctctttggcttccagatcatattcaccaaaagcattcggcaaaccggcattcgggtgcgcactgacataatattcagagatacgcgataactcagcaacatattggcgcagttcatccggccccagcgcacagttcagaccaaacgacagcggtttgacatggcgcagcgagttataaaaagcttccgtcgtttgaccagacagcgtacggccggaggcatcggtaatggtgccggaaatcatcaccggcaacagcacgcccatcgcttcgaattcgctttcaaccgcaaaggtcgcggccttcgcattcaacgtatcgaagaccgtttcgatcataattaaatcaacacccccttcaatcagcgcgcgggtagactcacgataggcctcgaccaactgatcaaaactgacgttacggaacgccgggtcattaactttaggggagatggaggcagtacggttggttggccccagcaccccggcaacataacgtggtttttctggcgtgcgggcgctccattcatcggcacagatacgggccagacgggcggcttcatagttaatttcagccgacagtgacgccatctgatagtccgccatcgcaatggaggtagagttaaaggtattggtttcgagaatgtcagcaccggcttcaaggtaggcattatggatcgccgtgatgacttctggcttggagagcaccaagaggtcattgttaccttttaggtcacttgcccagtcagcaaaacgcgcgcctcggtaatctgcttcttctaatcggtagctctggatcatggtgcccataccaccatccagtaccaaaatgcgttgcgccaactgctggtgcaattccttgaccttattatcgattactgtatccaccacattcgcctcttcaccctattgcctgccgtgtccggacgacacgccgcaaaactaatccgtcatcctagcacaagttgcaaacgtaatgagtccgctcacagttgagactttttcaggtagaaaagtcgactcatcggatgagtatttttagcggtttacatgcataattgaaaaacgaaaatgaattccataaaaatatttgaggggctgatttatggcgttaccgattccgattaaacggggaaagaaacccaaggcagccacacagaatacacctgcagcaacgggccaagttcaatcattgactcgcggccttaaattgctggaatatatttccgaatctgatgggaacgtcgccctgactgatttagcccaacaggcgggattacccaattcgaccacccaccgtttactcacgaccatgcaacagcagggttttgttcgtcaggtcggcgatttagggctatggaccatgggggcccacgcctttattgtcgggagcagtttcctgcaaagccgtaatttactggcgatggtccacccaatgttacgccgtttaatggatgaatctggcgaaaccgtcaatttggcggtactcgatcacagcgattaccaggcaataattatcgatcaagtgcaatgtaccgcgctgatgcggatgtccgcaccaattggaggcaagctccccatgcatgcctccggggcaggcaaagcctttctctccaccctgccggacgatcaactggttcagttgttacataaaaaggggttgcacgcttacacccagcacacccgtaccaatccaaccagcctgaaagaaaatctagcgctgatccgcaagcaaggttattcatttgatgatgaagagcacgccctcggcctacgttgtatcgccgcctgcttgttcgatgagcaccacgaagccttcgccgcgatttctatctccggcccaatatcacggatcaccgacgatcgcgtcaccgagctgggtgcactggttatccacgcggcgaaagagattacccaatcttacggtgggggaaccggggttaaataatagaatgaaaaataaaggaaaaatttgtcgttcggcgagaacaggccgatcgtaaagacgcgataaatagaggcgtagcgagctacgttaatctgagtacgttcagcgcgcagtcgccgttaatttaaagcccgctgggagaagcgttgctttcgtctataagcaaaaacatcctccacatgcccatcccggatacgctgctgcaagccgcgccaataactggcctggaacagatcgccgtgcatctcctcaaaaaagtgcctgactttccggtcactgcataagaaatggcgaaactcttcgggaaaaacatcattaggcgacacgctgtaccacggctcactggccatctcatcttcgggataacgcggtgggggaatatcgcggaaattaacctcggtcatataacaaatttcatcataatcgtagaacaccacccgcccatggcgcgtcacaccgaagttcttaaataacatatcaccggggaaaatattggccgcagccagttgtttaatggcgttaccatattcctcaatagcatccttcaactgctgatcatctgcctgctccatatagagatttaacggggtcatccttcgctccatatacaggtgcttaatgacgatcttgtcacctaaatcctccagtttttcgggtacttcatgttgcaactccgccagcagttctgggctgatacggtgcttatcaatcacaaaattttcatactcttgggtatccgccatgcgccctacccggtcatgttctttaactaattgatagcattctaaaactcgtgcttgagtgacctctttttgtggtgcaaattggtctttaatcaccttaaatacccgatcaaatgacggtaaggtaaagaccaacatcaccatgcctttcaccccaggtgcaataataaactgttcactggattgatgaataaaagccaaatactcgcgataactctctgttttaccgtgtttctgacagccaatcgccgtatacagctcagcggtagatttacccggtaatatttcccgtaaccattccaccattgcagccggcagcggcacatagaccataaaataagaacgagcgaagccgaacacgatactggcctccgctttgctggtcagacaggtatcaataaatagctcaccagactcattgtgatgaataggtaacaagaaaggatagatgtcaccgttcagcctcaatttacccaccaaccaagcggccttattgcggtaaaacaactcattcgctatttgaaaatgcgcactggctagctgctcatcggtaaaggcttgccgtatggccatcacgatataatcaatgtctcgcgacaaattttcccaaggtaagcgcagtgataaatcattaagcaccatctgcaacataccactgagatcccctttagggatgaaatcgcgggccagaggccgtgggatctcacggaagcgccgctcaggctgagagctaaaaacaaacaacttatcgggcgttaaatcgcggtgtttaaataaacggcaataaaccgaattaaaaaagctttcggcgatttcgaagcgcggataatccggtagcagcccggtataaatttctttcacccgcgccaaaaattccacatcaaaatggcgttgatccgtaatgtatttcagttgctcaaccactaaacccacatggtgatcataaaggtgaatacgctttttcatcgcctgctgtaccgcatgccaatcggcctgctcaaaacggtgttgagcaccggcagtgacctccagaaaacggccatattgcgcatcaaatccctgcaaaatggtctgagcgataagttgttctagctttgccaccatgctgccccctaccgtacaaaacggagcctgcataagcaggctcctgataagaccacactcactcaatcgtggctaaaactgctgctcttccgtcgaaccggtcagtgccgttacagatgatgcgcccccctgaataatattggtgactttatcgaagtagccagtccccacttcttgctgatgggaagcaaaggtgtagccgcggtccacagaggcaaactcaggttgctggactttctcaacgtagtgtttcatgccttcaccctgcgcatacgcatgggccagatcgaacatgttgaaccacatgctatgaatacccgccagcgtaataaactggtatttgtagcccatggcggagagttcatcttggaagctggcaatttgctggtcggtcagattcttcttccagttaaaggagggtgaacagttataagccagtaattttccggggaattgagcatgaacagcatcggcaaaacgtttggccagagccagatcaggtgtcgaggtttcacaccacaccaaatcagcataaggggcgtacgccagaccacggctgatcgcttgttcaataccggcacgggtgcggaaaaaaccttccgcagtacggtcgccggtaataaactcccggtcatagggatcgcaatctgaggtcaataaatcagccgcatccgcatcagtcctggcaatcaacagcgttggtacacccaagacatctgcggctaaacgggcagcaaccagcttttgaatggcctcttgtgtcggcaccagtaccttaccgcccatatgcccacactttttcactgcggccaattggtcttcaaaatgaacccctgccgcccccgcttcaatcatcgctttcattaattcaaacgcgttcagcacaccgccaaaacccgcttccgcatccgcgacgatcggtaggaaatagtcggtatagcctttactacctggctcaatattattcgaccactgaatttgatcagcgcggcggaagctattgttgatacgtttcaccaccgcaggcacagagtcgaccggatacagtgactgatctggatacatgctagatgccgtattagcatcagccgccacctgccatcccgacagataaatggcttcaacaccggctttcgcctgttgtagcgcctgaccaccggttaatgcccccagacagttgatataccctttacgcgacccgccgtgcagcaattcccacagttttttggcaccattttgtgcgaacgtacattctggattgaccgaaccacgcagcttgataacatcttcggcgctataaggccgagtgatatttttccagcgcggcgatgtccattcctgttccaactgctgaatttgttgagtacgagagatcgtcatggcgatgttccttataattcaattttgtagggttcaataggatggctcaggcaagcaatgcatagcccggcaacgtcaggaagtcgataagctcgtcttgtgttgtaatacgctccatcaagcgtgcagcttcttcaaaccgcccgcgatcaaaacgctctgcgccaagctcaagcttcacaacctgaatttcttcactcaacatgctgcggaacagctctttagtcaccgtctggccattactgaggcttttctgatgatgtatccattgccagatagaagtgcgggaaatctctgcagtagccgcatcctccatcaagccataaatcggcacacaaccattacccgatatccatgcttcaatgtactgcaccgcgactctgatattggcccgcatccctgcttcagtgcgctcgccagaacaaggttccagcaactcagcggcggtgataggtttatcctgttcgcggctaacctctaattgattaggccgagaacctaatactttgttaaaaacgtccatcaccgtatctgccaagcccggatgcgccacccaagttccatcgtggccgttactggcttctaactctttgtcggcacgaactttatccaacaccaacttattcttttctgcgtctttatccgggatgaaggcggccattccccccatcgccaaagcgccacgtttatggcatgtcttgatcaacaaacgggaatacgcgctaagaaaaggtttattcatcgtgactgactggcgatctggtaacacgcggttagggtggtttttcaatgtttttatatagctaaagatatagtcccagcgcccacaattcagaccaacaatgtggtggcgcaggtggtagagaatttcatccatttggaaaacggcgggtaatgtctcaattaataccgtcgccttaatggtgccctgcgatagaccaaagcgctgctcggtaaaattgaacacatcgctccaccaagcggcttcctgatatgactgcatcttcggcaaatagaaataagggccgctgcccttcgccagcagttgctgatagttatggtagaaatacaaagcgaaatcgaataaaccaccgggaatcgcctcgtcctgccatttaacatgtttttccggtaagtgcaggccacgaacacgtgcaatcaataccgcgggattaggttttaattgatagaccttgcccgattcattcgtataggaaattgtccctttcaccgcatcatgcagattaatttgaccatcaatcactttatcccaactgggtgccagtgaatcttcgaaatccgccataaaaacttttacgttggcattaagcgcattgatcaccattttccgctctactggcccggtgatctcaactctacgatcgcgtaagtcagcaggaataccttggattttccaatcaccatcacgaatggaattagtttccaaaataaaatcgggtaacgccccctgatcgatggtttgctgccaagatgcccttgtggcaaggagttggttacgcgattcgctaaatttcaccactaattcggttagaaactcgatggctttatccggtaaaacctgccgctcagcagcattaaaaggctgggtgaaaactaactctgtgcccgctaactgttgtctcattgctattccccttcccaatgttactgctgccaccttaacgctgacctcgcgtcactcttggattatcatcaggtaacgtgtccctgccagtaaaaaaggcagaattttatggttatttttcacccgacagaaataagaataatcaattaattcataaaatcaaaaacgatttccatttttatggaaaatatttttttaatctttatttatcatatcgttaacatttaggagggattggcaatgataggaatcagattccattattgatttttaatggctataactcattgtttagaaaagagatcggaccagatttagggaaggaaaaaggtaattggaagggaagaaaataataggcggcctcgattcagccgccataattagcatctatgcgacgatgaacatcgagaaggggaaaaatcaatcaagggtaggattcatatgtcgcaaatcaaatggcgtaatttggtaaacatagtagttgagccaattggcaaacagtagatgcccatgactgcgccatgatgcttttggtcgtaacgatgcatcgtcagaagggaaataattaagaggaacttgtgggttaaggcctgcagccagatcacgctgatattcacccgctaacgtatcgacatcatactcaggatgaccggtaacaaaagccacccgcttatctttactggcaaacagataagccccagcctcttctgacgacactaagatatccaaatcagtatattgttgaaggacttcaacgggaaaatcagcatagcgggaatgaggagccagaaatgtttcatcaaaaccacgcgtcaataaggccagcggttcgagtgtttgatgctgatagataccagagagtttgacctcgcgcgtcatcttcgggatgccatacaagatatttaacgccgcctgcaccgcccaacagacaaatagagttgatgtcacatgctcttttgcccaggcaataatacgttcaatttgtggccaataagccacatcacagaaatcgactaaacccagaggagcgccggttacgatcaagccatcaaaattctggtcctgaatgtcctcaaaatcgcagtaaaagttgttcagatgctccgtaggcgtatttttagactcacgactatcaaccctcaacaattgaatatcaacctggagtggcgagttagagagtaaacgtaggaattgattctccgtctcaatttttttaggcatcagatttaaaatcaataccttcaggggccgaatttcctgagttttagcacgcgatgaagccatcacaaaaacattctcattgcgcaagaaactcactgcaggtaattcatcaggaacccgaattggcatgcctacatcctcaatatatccgtttatacgtttagacttctagatgcctgaagatagcggatcttagatgaaaagtcgagcgaactgtaacaacctgaaaatgtttcatcgcggcagtgagttcatcacagtgagtttatataaggcgggaaagggggcactagagaatagctttaaattgcttatcgtatataacgttgcttatcgcatatattgtttgggtaaagctatcaacttcaggacactcattagtatcaacaccagtataaggtgtctgcttaacagcttaaattttaaactcatcagtgacatttttatcggaatcatattgcccatttgacggcaattgtgtggcaacaaagtatctgtgggaagcggagcgattcacgactaacaaaatcagacaaagggaaaatatgctgttgaagccgtagtgccgtaagccaccgaagtgctcttaagtgcggtaattcctttgttcagcggactataaaacagattttttatcaatggagaggataggcaagatcgtaaatacgccatattttctatattaaaataacgttgataggggctagaattacgctatatatgaacgtcttacgcctccttgcctattcttaccgcttaaccacttaaccacttaaccactcaagatcgagtcactagagtttgttaaaactatttaggacggatcgcaaaaacagaaaaggccaccctaatggatggcctttctgtttatttgatacctggcagtgtcctactctcgcatggggagaccccacactaccatcggcgctacggcgtttcacttctgagttcggcatggggtcaggtgggaccaccgcgctattgccgccaggtaaattcttttctactactgccgaatttaatccatgtaactggtgctgatacccagagtcgaactggggacctcacccttaccaagggtgcgctctaccaactgagccatatcagcacaactaaatttgatgcctggcagtgtcctactctcgcatggggagaccccacactaccatcggcgctacggcgtttcacttctgagttcggcatgggatcaggtgggaccaccgcgctatggccgccaggcaaattctgtttcaattaacccgcaaacaagcaacacttgtcagccagtcaacacaatctcggaacgacgctgaaaatctctctcaattcaaaacaccttcggtgttgtaaggttaagcctcacggatcattagtactggttagctcaatacatcgctgcacttacacacccagcctatcaacgtcatagtctttaacgttccttcaggggactttaagtcccagggaagactcatctcgaggcaagtttcccgcttagatgctttcagcggttatctcttccgaatttagctaccgggcaatgccattggcatgacaacccgaacaccagtgattcgtccactccggtcctctcgtactaggagcagcccctctcaatcttccaacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactaagacctactttcgtacctgctcgagccgtcactctcgcagtcaagctagcttatgcctttgcactaacctcacgatgtccgaccgtgattagctaaccttcgtgctcctccgttactctttgggaggagaccgccccagtcaaactacccaccagacactgtcctcaccccagattatggggccgagttagaacatcaaacattaaagggtggtatttcaaggttggctccatgcagactggcgtccacacttcaaggcctcccacctatcctacacatcaaggctcaatgttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttactggggcttcgatcaagagcttcgccttgcggctgaccccatcaattaaccttccagcaccgggcaggcgtcacaccgtatacgtccactttcgtgtttgcacagtgctgtgtttttattaaacagttgcagccagctggtatctgcgactggcttcagctccaggagctagtcctttcacctaacgccagcgtgccttctcccgaagttacggcaccattttgcctagttccttcacccgagttctctcaagcgcctgagtattctctacctgaccacctgtgtcggtttggggtacgatttaatgttacctgatgcttagaggcttttcctggaagcatggcatcaactgcttctgcaccgtagtgcatcgtcatcacgcctcagggttgataagcaaccggatttacctggtcactccccctacacgcttaaaccgggacaaccgtcgcccggccagcctagccttctccgtccccccttcgcagtaacaccaagtacaggaatattaacctgtttcccatcgactacgcttttcagcctcgccttaggggtcgactcaccctgccccgattaacgttggacaggaacccttggtcttccggcgtgcgggtttttcacccgcattatcgttacttatgtcagcattcgcacttctgatacctccagcaaccctcacaggtcaccttcaacggcttacagaacgctcccctacccaacaacacctaagtgtcgctgccgcagcttcggtgcatggtttagccccgttacatcttccgcgcaggccgactcgaccagtgagctattacgctttctttaaatgatggctgcttctaagccaacatcctggctgtctgtgccttcccacatcgtttcccacttaaccatgactttgggaccttagctggcggtctgggttgtttccctcttcacgacggacgttagcacccgccgtgtgtctcccgtgataacattcttcggtattcggagtttgcatcggtttggtaagccgggatggccccctagccgaaacagtgctctacccccgaagatgagttcacgaggcgctacctaaatagctttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccttgcaactagacgcccagttaagactcggtttccctacggctcccctattcggttaaccttgctacaaaatataagtcgctgacccattatacaaaaggtacgcagtcacaccacgaaggtgctcccactgcttgtacgtacacggtttcaggttctatttcactcccctcgccggggttcttttcgcctttccctcacggtactggttcactatcggtcagtcaggagtatttagccttggaggatggtccccccatattcagacaggatgtcacgtgtcccgccctactcatcgagttcacagcctgtgcattttggtgtacgggactatcaccctgtaccgtgcgactttccagacgcttccactaacacacaaactgattcagactctgggctcctccccgttcgctcgccgctactgggggaatctcggttgatttcttttcctcggggtacttagatgtttcagttcccccggttcgcctcgttagactatgtattcatctaacgatagtgcaacgtattgcactgggtttccccattcgggtatcgtcggttataacgcttcatatcagcttaccgacgcttttcgcagattagcacgcccttcatcgcctctgactgcctaggcatccaccgtgtacgcttagtcgcttaacctcacaacccgaaggtgtcttatcattgctgacagtacatcttgtgttgcgattatttgagagactctattacaggttactctttaccccaatacatctacggcggggtaaatttcagctgtaatgtttcaattttcagcttgttccagattgttaaagagcaatatttcacaacacactgtgccttgcgaccgcagtacgttttgaaatagttttatatggtggagctaagcgggatcgaaccgctgacctcctgcgtgcaaggcaggcgctctcccagctgagctatagccccatataaaaagcaaatcaccttattgctgcaactcaacagggaatggtgagttggtgggtctgagtggacttgaaccaccgacctcacccttatcaggggtgcgctctaaccacctgagctacagacccaacaaggtactaaagcccgaccaatttctcagcccggctttatttgctcgttactttctatcagacaatctgtgtgggcactgcgcaatgcgtatcgttaggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgacaaggcccgggaacgtattcaccgtagcattctgatctacgattactagcgattccgacttcatggagtcgagttgcagactccaatccggactacgacagactttatgtggtccgctgactctcgcgagttcgcttcactttgtatctgccattgtagcacgtgtgtagccctactcgtaagggccatgatgacttgacgtcatccccaccttcctccggtttgtcaccggcagtctcccttgagttcccaccattacgtgctggcaacaaaggataagggttgcgctcgttgcgggacttaacccaacatttcacaacacgagctgacgacagccatgcagcacctgtctcacagttcccgaaggcactttagcatctctgccaaattctgtggatgtcaagagtaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccacgcctcaagggcacaacctccaagtcgacatcgtttacagcgtggactaccagggtatctaatccttgtttgctccccacgctttcgcactctgagcgaagtctttgtccagggggccgccttcgccaccggtattcctccagatctctacgcatttcaccgctacacctggaattctacccccctctacaagactctagcttgccagtttcaaatgcagttcccacgttaagcgcggggatttcacatctgacttaacaaaccgcctgcgtgcgctttacgcccagtaattccgattaacgcttgcaaccctccgtattaccgcggctgctggcacggagttagccggtgcttcttctgcgagtaacgtcaatgattgagcgtattaaactcaaccccttcctcctcgctgaaagtgctttacaacccgaaggccttcttcacacacgcggcatggctgcatcaggcttgcgcccattgtgcaatattccccactgctgcctcccgtaggagtctggaccgtgtctcagttccagtgtggctggtcatcctctcagaccagctagggatcgtcgcctaggtgagccattaccccacctactagctaatcccatctgggttcatccgatggcgtgaggccctaaggtcccccactttgctcttgcgaggtcatgcggtattagccaccgtttccagtagttatccccctccatcaggcagatccccagacattactcacccgtccgccgctcgccggcaaagtagtaactctgcccgctgcgctcgacttgatgtgtaggcctgccgccagcgttcattctgagccatgatcaaactcttcaatttaaaatattggtggaattggtggcttttaactggcggaaaaacaggcggggctcaaaaatatatttttgcaaatagggattctgaccgaagtcaaaatgtttactgctttggtcactcttcaagacttgatattatttctgcctgccgaaacaggcgtcgatatcgtcttgcgagtgcccacacagattgtctgataaattgttaaagagcagtgcgttagcaacacttggttggtaacgcgaggtgcgcatattacgctttcctcattcagagtcaactacttatttcgttgaatttctctgttctctttgccggccactcaacgatttgattcgttgtgtgccgtctcgatggatgcgcattatagggagtcgatttttttgcacaactcttttttcatcttttcctgctgtttgaatacttttcactccttacggacagatcttggtcgatccgttgcattttaacgacgatcctaatggtcagttggttgtaattccatcagcaaaagctagtattgccggtaaacgtgatcttattaagaggctattattatgtgcgactctatccgcccttatcttcatcattcaccgactttaggtaaacgagtcatgatcgatagatcgagtgtgatcattggcaatgttattttaggtgatgatgtcagtgtctggccattagtcgccattcgtggcgatgttaatcaagtcatcattggggcacgttcaaatatccaagacggtagtgtgctacatgttacccaccaatctgagcataatcctgaagggtatccgttaatcattggtgaagacgtgactattggtcataaagccatgctacacggctgtaccattggtaacagagtattagtgggtatgggatctattctattagatggaacaataatagaagatgatgtaatgattggtgcaggtagcctcattgctccaggtaaacgcttagttagtggctatctttatgtgggcagcccagcgaagcaaatacgcccattaacacccttagagttagaaggcctgctttactctgctggcaactacgttcgctggaaagatgactatctggcagagtctaaataaccgaatgatatgcagggcgaaatataacctccctgcattcattggtgtgtgcttctatttacctaactcactgcgtagctgggctaatactggcgtaatttcaggcatcacaccgtgccaaagtttgaaagcatgtgctgcttgccctaccagcattcctaaaccatcggcataatctgctaaacccaatcgttgtgcccaagccaagaatggtgtggttcccgcctgatagaacatatcgtaacaacgtgtttgagaagtaagtatagctgctggtaagttaggtacctctccatgaaggcctgatgccgtcgcatttataaccaaatcgaatcgttgtccagccaactccgacatttcacaaacatcaatatcaccaatatggttaaatactttggccagttgctgcgcccgggtatgtgtccggttggtaacaaccacagtacacccataagaaagtagaggaaggatcactcctcgggcagcgccaccagccccaaccaacaaaatatgatcagttgttcggatcaagttttgtcgttcaagatcactgagcaaaccaataccatctgtgttgtcacccaacaagcgcccatcttccaaacgcttaatcgtattaacagcccctgccagagatgcacggtcggttaattcatcacattggtcatatgcgcgttctttaaacggtgtggtaatgttcgctccctgggcaccatcagcaaaaaaagatactaatgtgttctcaaaggcttcagaaggagctaataccttaccatatcgatgttcaatgcctgtttgctcggaaaaaagcgtatggatcctcggcgatttactatgactaataggattaccaaatactgcaaacttctgatccatacaatatcctacccttggcgaaaccgcttacccgttaaggcatctctgatttcagatggattcaaacggccaccaacgtgaccggataacaccggtaatgaagggccaaactgtattctgacttcttcttccgtgcggcacggctcatgcccacttaaattagcgctagttgacactaacggcttgccatattccgcacaaagctgctgtacaagtgggtgattgcttactctcaccgccaatgagtcaaaacagcctgttagccattgcggtgtttctactcgggcaggtatcacccacgttatcggccccggccaagtggaaaagagggtttctcgttgtatttcattaagcattgaatcattaatataaggctctaactgagcataattagcggcaaccaagatcaaacctttctgccatggccgctgttttaacgctagcaaagtattaaccgctttttcactatcgggatcgcatcctaaaccaaaaactgcttctgtcggataagcgataacctcttcttgccgcaatgcccgcactatatccgccagcacaaaattattttcttgttgattcatactatgactcactggctacagccttcccacataacttactggcacagatacgtttgataccccgtgccgttcttttttctattaacagtgggtagtggcaataaccacactttcctgcaattggcggttggttgagcgtaaattgacagtcggggtagcgattacaggcatgaaaaactttcccaaaccgagacttacgttgtaacagtttcccttgaccacactgtgggcaatcaatagacgtctcatcaggtttatctataacttctgtatgatcacactgtggatattggctgcaaccaataaacataccgaagcggccttggcgtagcaccatatccgaaccacactcaggacaaggttgcccttccagagttttcacaacatgcccgtcagcctgcgcttttagtgggcgtatatactggcaatctggataatgtgaacaaccaaggaatggaccgtgccccccactgcgaatcaccaacgctgacccgcactcaggacaagatccattatccttagtaataactttcttcgtcataacgccttctatataagccattagccagcaatcttagcacctagtgcaaataaccgtcattgacttcaaagagcagctcttccatctgcttataggcattttcataacccggtatattgaataacaccatcagcacaacccatttaagatcttcaagatcaatctcgggggaatcaagcgccatgatacgatcaatcaccatctcacgagtatcaaactgtaatacctgaatttgttcaaggaagaggataaaaccacggcaggcagcccctagacgccgacactcttccacagtatagatacgtaaagcttgtggatctgcggtatagagataaggggctttctgcccttcctgtagatcagcgaggacctctaaccagttcagggcgttgttgatatcctcacggtagaaacctgcatcagcaagatcgtcagtaatcttgtcctgatcgacaagcatttccggttcgttgtgcatgtaagtttcaaataagtaaattagaacgtcgaacatggcctgccctccttattcggacatagccgccgggtacagctgcgatccaccctgctaactccagctcgagcaatttgctggcaatatcttgcacaggttggccggcacgttcggcgacaacatcaacaggtgtcacctcatcccctacgttagccaacacatcagcaaatggcaattcaacttgctccttcggtgaagaaataattacttcctctggcaatgataaccattgcaaagaaccactgacctgctctgagacatctttaacagacgttgccaaataagcgccttgttgaatgagccaatgtgttccttcgctgctagcactgcctaatggccccggtaatgcgaacacatctcttccttgatccatcgcataacgagcggtaatcaaagagccactttttaaagtggcctcaacgactaacacagcatcacttagcccgctgataattcgatttcttctggggaaatgagcagcaataggtaacgccgtcgttaaaaattcagaaaccaaagcgccgccttgatattcaatttctttagccaaacgactgtgccgctgtggatatatgttctccaacccactccctagcacagcaatagttctcccttgaatattcagagccgcctgatgacaaattccgtcgatgcctacagctaaaccactagtgataactaaccctgtgcgagccaactctgaggcaaaatatcttccccactgctcaccatagtggctgaaatgacggctaccaaccattgcgatctgtgggcgatagagaacatcaagttcgccggaaacaaagaggactaacggtgccccagcaatatgaactaagcggggtggatagccaggctcaccataagtgagtaaatggtggttggggtcacttagccactctagcgtgtctgcaatataacggggtgacaactgagcaaactgatgacactgttgtgaatctagcccgtaggcagctaacctccccggatgaatatcaccactggcaagtaatcgcttggccaacgcactacgtttcacgactccaagccctttaacctgagtcatccgtagccatagttctgctgctaacataccgcctccctggcttactttccggtgttgacaccaatttgttcaattggtagacgatgctgtcaattagaacaagaaatgtctagaatagagattgaatatcattcactactcggacgcagatctagatatttatgtcagtattacaagtattacattacccagacgaacggctgcgcaaaattgcagcgccggtaaaagaagttaatggtgaaatccagcgtattgtggacgacatgttcgagactatgtacgcagaggaaggcattgggcttgccgcaacccaagtggatgttcaccaacaaattattgtcattgatatatcggaaaaccgtgatcaacgcctggtgttgataaacccagaacttttggaaaaaagtggtgaaacgggtattgaagaaggctgtttatccattcctgagcaacgagcactcgtccctcgggctgaaaaggtcaaaatcagggcactggatcgagatggcaagccgtttgaactagaaactgatggtttattagctatttgtatccagcatgaaatggatcatttgattggcaaactgtttgtcgattatctgtcaccactcaagcgtcagcgtatccgccaaaagctggagaaaatggccaagctcaatgcccgcgccaactaaacttttctaacgcaggaaaccaacgtgtctgattctttgcggattatttttgccggaactcctgattttgcagcgcgccatttaggcgcgttgctctcttctcaacataagattgttggtgtgttcactcaaccagaccgcccggctggccgaggtaataaactcacccccagcccagttaaaatattggcagaacaccacggcatccctgtttttcagcccaagtcattaagacctgaagagaaccaacatttagttgccgacctcaatgctgacatcatggtcgtagtggcttatggcttaatactacctgcagcggtgttagcgatgccacgtttaggctgcatcaatgttcatggttcgttactcccacgttggcgtggtgcagcaccgatccaacgttcagtatgggcgggtgacgaaaaaacggggattactatcatgcagatggatatcgggttagataccggtgctatgctgcataaaattgaatgtgccattcaaccagaagataccagtgcgacactgtatgataaattagcacaattggggcctcaagggctgttgataacattacaacagctagccgcaggcacagccctagcagaagttcaaaatgaaacacaagcaacctatgcggagaagctaagtaaagaggaagccaaattagattggacactttctgcaactcagttagaacgctgtatccgtgcatttaacccttggcctgtcagctattttattgttgatgaacagccaatcaaagtttggcaagcgcaggtactccctgctggcgaggatgcagaaccaggcaccattatccatgcagataagcatggtatccaagttgcaactgctgatggcgttttgaatatcacacaactccagcctgcagggaaaaaagcaatgtcagccgctgacttattaaactctcggcgagaatggtttataccaggtagtcaactagtgtaatcgttcggctccaataatacctttcatcgcccaatacttcgtcattgggctacttctccctttatttgctggcgtttgtcagcttttttggttatgaaaaatacatataatctccgcagtatcgctgctaaagcaattagtcaggtattggatcagggccaatcgctcagtgccgttttgcctgaattacaaaaaaatatttccgataaagatcgcgcattgctgcaggaactgtgttttggcactctgcgagtcttaccacagctagaatggtgtattcaacaacttatggcacgcccgatgacgggtaaacaacgtgtttttcattacctgattatggttgggctctatcagttgatttacactcggattccgccacatgcggcgttggctgaaacggtcgaaggcgcaacagtactgaaacgtccacaattaaaaggacttatcaatggtgtattacgccaatttcagcgtcaacaagtggaattactggaacgtgctgtaaataacgatagccactatctgcatcctagttggttgttggcccgcattaaacaagcctatccagcacagtggcagcaaattttggatgccaataaccaaagaccgcccatgtggctacgtgtaaatcgcctgcatcattctcgtagtgaatacctcgaactgttaacacaggctgatattaatgcggagcctcaccctatttatcgtgatgctgtgcgccttatcactccttgtgccgtcaatcatctacctggctttgaacttggttgggtaaccgtacaagatgcttcggctcaaggttgtgttgacctactcgatccccaaaatggtgagcagatccttgatttatgtgcagcccctggaggtaaaaccactcatattctggaagccgcaccaaaggctcatgtattagccgtagatattgatgaacagcgactcagtcgagttaaagagaatttacaacgcctgcaattacaagccgtagtccgtgttggtgatggccgagcacctgacacatggtgcggtgatcagcaatttgatcgtattctattggatgcaccttgttctgcaaccggtgttattcgccgccatccagatattaaatggctgcgtcgggaccgtgatatttccgaattggcccaactacaatcagaaatcattgaggctatttggcctaaactgaaacatggtggagtactagtttatgctacctgttcaatattgccggaagagaaccaacagcagattgccgctttcctacaacggcatcccgaagcacagttgaccgaaaccggtactacagcagcgcctggtaaacaaaaccttccacatcctgaggacggtgatggtttcttctacgcaaagataatcaaaaaatagtctgtggcttttgctatgcctcaaaacctaatttcagtgtgaaacagagaacgctatgaaaataattattcttggggcagggcaagttggcgggaccctggcagaaaacttggtgggtgaaaataacgatatcactgtagtcgatatcgactctggtcgactacgccaactgcaggataagtttgatttacgtgtagtacaagggtatggctcacaccctagagttctacgagaggcaggagctgaggatgccgatatgctggtagccgtgactaattctgatgaaaccaatatgattgcctgccaaatcgcttactcattattcaatacaccaaatcgcattgctcgcattcgatcaactgaatatatacgtgaagcagataaactctttctgcccgaagctgtaccgattgaccatttaatctcacctgaacaactagtcattgactatatctataagttaatcgaataccctggagcactacaggtcgttaactttgctgaaggtaaagttagcatcgcagcagtcaaagcctactatggcggcccattggtagggaatgcattgtcatccttacgtgaacatatgccacatattgatactagagtcgcggctatatttcgccaagatcgaccaatccgtccacagggatcaacaattattgaagctggtgatgaagtcttttttgtagcggcctctcagcatatacgagcggtaatgagtgagttacagcgcctggaaaaaccgtataaacgcattatgattgtcggtggtggtaatgtcggtgcaggtctggcactgcgtctggaaaaagactacagcgtaaagttaattgaacgtgaccaacagcgggcagctgaattagctgaaatgctacacgatactatcgtattttatggtgatgcatcagaccaagaattacttgcagaagaacatattgaacaggttgatgtatttatcgccattacaaatgatgatgaagccaatattatgtcggctatgctggcaaaacggatgggtgcgaaaaaagcgatggtacttatccaacgcagtgcttacgtcgatttggttcagggaagcgttattgatattgttatatcaccgcagcaagccactatttcagcactattaggtcatgtccgtaaagcagatatcgttagtgtatcctcgctgagacgtggcgttgctgaggcaatagaagctattgctcatggtgatgaaagcacttcaaaagttgtcggccggatggttgaagacataaagttaccaccaggaacaactattggagctatcgttcggggggatgaggttattattgcaaacagtaactccataattaagcaaggggaccatgtaataatgttcattacccacaaaaaatttgtacccgatgtggaacggttgttccaaccaagcccattcttcctataactaataatcattaatttctggcatccttataaaaagccatgctcatgaggaaataattaaaatttccctataattttagtgataataggcattatttagctagaattaagtcattcatttattgatggggtgttggctatgagctttatgaaagaatttcgtgaatttgccatgcgtggcaatgtggttgacttagctgttggtgtgattattggtgctgcattcggcagaattgtctcttcgctcgttgccgatattatcatgccaccactggggttattgctaggcggggtagattttaaacaattccattttgtattacgagccgctgaagggactatacccgcggtagtaatgaattatggtacatttattcaaagcatttttgattttgttattgtagccctcgctatattctccgctgttaagttaatgaataagctacgccgtgaaaaagcggaagaagaacctgctacaccgccagcaccaacgactgaagagatactattagctgagattcgcgatttattaaaagcgcagcacacaaaatagtttcagtttagctaaatttaagagctaccggaatgagttgccctaaacagcaacacaaaagcgggtatttggattaagtccaagaagataactttttatttcttttaaatcagaaggccagtagtaaaaaatctattgattgcttaccactggcctcccagttactaccttttgcatatttctctttgcgctgataacttcctttgcccttactatttttctcaatacgctgtctgaataatgggtcgtggagtagagcttccagtgcattatctttaatttttcccttggtatggcgatatgttgtcatggtgctacctcgtagtaatgacgctatggataaatcctgaacataatacggtggtcctctgccgatttaaaccctctgtagagaaattcataccttaattaactcttctgttgccccctgctccaaagcttccaatattgagcagtatgtcgtcgcatgactagtgccacaacaagcctcgctgagtctttttagggaatcacgcattctctctaattctctgatcttaccttccacatcactaagccgtgaatctacaatagacttggactcctggcaggtatgatggtcaggatctatccggatcgacaataattctgcgatagtatccaatgtaaagcctagttgcttggcgtagcggataaaccgtaaacgctgaaggtcctgatcagtatacagccggtagccaccatcagttcgttcaccgtgatccatcattccctgcttttcgtagtaacggatagtatccggcgttacatcagcaagtttagctaactgcccgatttttaacatattgtccacctaccagccaattcctgttgataatcaacagcgtataaaataaggagttggaagtcatcatgttacagacctcattaagaaaaaatctcatgataatcaatacattttgcctatcctataattgaaacagagatagtctgtaccgttgaagatgcgctaatagcccataactccactaaaatatagctagatacaacaagagctctatgagacggtagatgataaaaatcattttccttctgtaaataatggatgcacctttctggtcattaattaacgactattctaccggtaacaacttgtgtagttaattaaagataacggatcgacgcggtgatcataagaggaaagtagtagtaaaacggtaggataatcgaagctgtatatggtgggcgtaaaaaaaccgggcaagcccggtttttttacgcgtttacagattactctgcagcaactacttctgcttgcgatgcagcacgatcaactaactcgatgtaagccatcggtgcgttgtcgcctgcacggaagccacacttaagaatgcgagtgtaaccaccggcgcggctcgcgaaacgcgggcctagctcgttaaacagttttgccacgatctcgttatcacgagtgcgggcgaatgccagacgacgattagctacgttgtcggtcttggcaagagtaatcagcggctcaacaacgcgacgcagctctttcgctttcggcagggtcgtcttgatgatctcatgacgaaccaaagagccggccatgttacggaacatagcctggcgatggctgctgttacggttcagttgacgaccactcttacgatggcgcatgaccttatccttctcagtaaaaccttaacctgtgatccggttactcgtcagcaatgctagctggtggccaattttctaggcgcatgcctaaagaaagaccacgtgaagcgagcacgtctttaatctcagtaagagattttttacccaggttcggcgttttcagcaactcaacctcggtacgctgtaccagatcaccgatgtagtggatagcttctgccttaaggcagttagcagagcggacagtcaattccagatcgtcaacagggcgcagcaggatcggatcgaactctggcttctcttctttaacttccggctgacgtacatcacgtaggtcaacgaaagcttcaagctgttcagccaagatagttgccgcacggcggatcgcctcttcaggatcgatcgtaccattggtttccatctcgataaccaacttgtccaggtcggtacgctgttctacacgcgctgcttcaacattgtaggcaattcgctctacagggctatagcatgcgtctactaacagacgaccaatcgggcgctcatcttcttccgaatgaattcgggcagaagccggcacataaccacgaccacgctgaactttgatacgcatattaatagatgcgttttcatcggtcaggtggcagataacgtgctgcggcttgacgatttcgacatcaccatcatgggtgatatcggctgcagtcacagggccaatgccagatttattcagggtaagaataacttcatctttgccctgaactctcaccgccagccctttcaggttgagcaggatctccaggatatcttcctgtacgccttctttggtgctgtactcatgtagtacaccatcaatctcaacctcggtcaccgcgcaacccggcatagatgaaagcagaatacggcgcagtgcgttgccgagagtatggccaaagccacgctctaacggctcaagggtcaccttggcgtgcgtcgaactgacttgctcgatatctaccaggcgcggttttagaaactctgtcacagaaccctgcattgtgtcctctctttggtactaagctttacttggagtaaagctcgacgatcaggtgttcgttaatgtccgcggacagatcagtacgttcaggaatacgtttgaacacaccttccatcttgacagcatcaacttccagccaagtcggcttttcacgctgttcagccagctccaaagctgccttaacacgagactgctttttagctttctcacggatgctgactacgtcattcggagatacctgataagaagcgatgttaacaacgcgaccatttaccatgatagctttatgactcaccagctgacgtgattcagcacgagttgcgccaaagcccatacggtaaactacattgtccagacgaccttcaagcaattgcaacaggtttgcaccagtattgcctttcagacgtgctgcttctttatagtagttacggaattgacgttctagaacaccatagatacggcgaactttttgtttctcacgtaactgcacaccgtagtcagacagacgcggtttacgcgcaccgtgctggccaggtggttgttcaatcttacacttggtgtcaatcgcgcgaacaccagacttaagaaacaggtctgtgccctcacgacggctcagcttgagcttaggacccaaatatcttgccattttctctctccaacaaacctaaaagcagcgttatacgcggcgctttttcggcggacgacaaccgttatgagggatcggagtcacatcagtaatattagtgatgcgaaaaccagccgcgtttaacgcacggatagtagactcacggcccggaccaggtcctttaaccataacttccagattcttgataccgtattctttcactgcttcagcgcagcgctctgctgcaacttgcgctgcaaacggagtagacttacgagaaccacggaaaccggaaccacctgctgttgcccaacccaatgcgttaccctgacgatcagtaatggtaacgatggtgttgttgaaagaagcatggatatgagccacaccgtcagagactgtctttcttacacgcttacgtgcacgaataggtgcctttgccattattcaatcaccccgattatttcttgatcggtttacgcggacccttacgggtacgtgcgttggtcttagtacgctgaccgcgaactggtagaccacgacgatgacgcaaaccacgataagtcccaaggtccatcagacgcttgatgctcagggtcacctcacgacgcagatcaccttctacaacgtacttggcaacttcgtcacgcagcttctcgatttgctcttcagacagctcactgatcttaacatgttcagcaatacccgcagcaacacagatagcctgtgagcgagttttgccgatgccgaagatcgcagttaaagcgataacggtatgtttctgatcaggaatgttaatgcctgctatacgggccactatgcactcctactattttatacagcaataccattctgaaaagcccgttttcaggatactcaaatagcattgcagtcacatacaaaagattggctggctaatctagccagctcaacccaactttgcaagaaaaatatgcaagataaatcagccttgacgctgtttatgctttggttcggcactgcaaatcacgcgaacgacaccgttacgcttaacaattttgcagttacgacataatttcttgacggaagcacgaactttcatttttactctccgtaacttctcaaacatccctgattagcggttatagcctttcaggtttgctttcttcaatgcagactcatactgactagacatcatcagagtttgcacttgagccataaagtccatgatgaccaccactacaataagtagggaggtaccaccaaagtaaaatggtactttcatcgcgtcacgcatgaactccgggatcaggcagatgaaagtaatatacatcgcaccaattaaggttagacgtgtcattactttatcgatgtacttcgccgtttgctctcccggacgaattcctggcacgaatgcaccggacttcttcaggttatctgctgtttcacgcgggttgaacactaacgccgtgtagaagaaacagaagaagatgattgcagacgcatagagtaacacataaagcggctgtcccggctgcaaatacatcgaaatagtcgtcagccagttccaacctgttccgcccccaaaccatgatgcaatcgtggcaggaaacagaattatgctggaagcgaagattgcagggataaccccagccatattcactttcaacggtaagtgtgtgctctgtgctgcataaacacgacgaccttgttgacgttttgcatagttaacgacaatacgacgttgaccacgttcaatgaaaacaacgaagaaggttactgcaaacactaatactgcaaccaacagcaacaggaggaagtgcaggtcgccttgccgagcttgctcgatggtatgggcaattgcaggaggaagccccgcaacaataccagcaaagattatgattgaaataccgtttccgataccccgttcagtaatctgttcacccagccacatcaggaacatagtccctgtgactaagctaacaacagcggtaaaatagaaagcaaagcctggattgattaccagaccttgcatcccaggcatattcggaagaccggtagcaataccgatcgattggaatatagccaataccaacgtgccataacgggtgtactggctaatcttacgacggccagcttccccttctttctttatttctgctaacgctggatgtaccaccgttaacagttggataataattgatgccgaaatatacggcatgatacccaaggcaaagatagaagcacgactgagagcaccaccagaaaacatgttaaacatttcaatgatggtgcctctctgctgctcaagcaatttggcaagcacagtggcatcgataccaggaatcggaataaaagagccgatacggaaaacaataagcgcaccgataacaaacaaaagtctgcgcttcagctcgcctaatccgcctttagcactttgaaaatctaatcctggttgcttagccatctgctacttattcctcaattttaccgccagcagcttcgatagcagcacgagcgcctttggtgactcgcagaccacgaagagttaccgcacgattgacttcgcctgaaagtataactttcacgaactccatctggataccaacaacgttagcggctttcagcgtgttcaggtcgattacgtcgccttccactaaagcaagttcagacagacgaacttctgccgtgatcatcgctttgcgagaggtgaagccgaatttcggcaaacgacgatataaaggcatctgaccaccttcaaaaccacgacgtacgccaccaccagaacgtgagttctgacctttgtgaccacgaccagcggttttacccaggccagaaccaataccacgacctacacgcttcggcgcatgcttggcaccttcagccggagacagagtatttaaacgcatctgttactcctcaactttaaccatgtaggaaaccaagttgaccataccacgcacagcaggagtatcctcacgctctacagtatgaccaatacgacgcagacctaaaccgatcagagttgccttatgtttcggcaaacgaccgatactgctttttgtttgagttactttaatagtctttgccatggttatttccctagaatttcttcgacggacttaccacgcttggcagcgaccatttctggggatttcatatcttccagagctgcaatagttgcacgaaccacgttaatcgggttagtagaaccataagctttagctaatacgttatgaacccctgcaacttctaaaacggcgcgcatggcaccaccggcgataataccggtaccttcagaagctggttgcatgaatacacgagaacccgtgtgagcacctttaactgggtgctgcagagtgccgttattcaaagcaacgttaatcatagcgcgacgggctttttccatcgctttttggatcgctgccggaacttcgcgtgctttgccgtagccaaaaccaacgcgaccgttaccatcaccaactactgtcagtgcggtaaagctgaaaatacggccaccttttacggttttagatacgcggtttaccgcgatcagcttttcctgcagttcgccagcttgtttttcgatgtgagacatcttacacctctaccttagaactgaaggccagcttcacgggcagcatctgccagtgcctggactcgaccatgatattggaaaccggaacggtcaaaggatactttcgtgatccctttttccaacgcgcgctcagcaatagttttgcctacagctgctgcggcatctttgttgccggcgtacttcaattgctcattgatagctttttctacagtagaagctgctaccaaaatttcagaaccgtttggtgcgataacctgcgcgtaaatatggcgtggggtacgatgtaccaccaggcgagtcgcacccagttctttgagcttgcggcgtgcgcgggtcgcacgacggatacgagctgctttcttatccatagtgttaccttacttcttcttagcctctttggtacgcacgacttcgtcggcgtaacggacacccttgcctttataaggctcaggacgacggtaggcacgcaaatctgctgcaacctgaccaatcacctgcttatcagcgcctttcagcacgatttcagtttgggtcgggcactcggcagtgatgccagccggcaattcatggtcaactgggtgagagaagcctaaagctaaattcaccacgttgcctttaactgcggcacggtagcctacgcctaccagttgaagcttcttagtgaagccttcggtaacaccaatgaccattgagttaagtagtgcacgagtggtacccgcttgggcccaaccgtctacagcgccttcgcgtggagcgaaagtcaatgtattttcttcttgcttaacttcaacagcactatggacggtacgagtcagctcgccgttcttacccttaatcgaaataacctgaccgttgagttttacctctacgccggcaggaatgacgacgggtgcttttgcaacacgagacattctttcctcccgaattaagctacgtagcagataatctcgccaccaagaccagcttggcgagctgcacgatcggtcataacacctttagaggtagaaataacagcgatacccaaaccggccataacttttggcagctcatcttttttcttatagatgcgcagacctggacggctgatacgttgaatgctttctaccactgccttaccctggaagtacttaagtgctaattccagaacaggcttggtgtcgccttcgattttaaaatcttcaataaagccttcttccttcagaacgttggcaattgccactttcagcttggaggagggcatggtgaccgcaactttgtttgcggcttgaccgttacggatacgggtcagcatatccgcgatcggatcttgcatgctcatctgtctttactcccgtgattcaattggtgacaattaccagctagccttcttaaggcccgggatttcaccgcgcatagcggtttcacggactttaatacggctcaacccgaacttccgcaggaaaccatgcggacgaccagtttggttgcagcggttacgctgacgggacgggctggaatcacgcggcagagactgcagcttcagaacagcatcccaacgatcttcgtcggatgagttcacaccagagataatagcttttaattcctcgcgtttagcgcggtatttgttagctagtttcacgcgaacaacttcgcgtgctttcattgattgcttagccatcagtaaccctaccttacttgcggaatgggaatttaaaagcagccaacaatgcacggccttcatcatcggatttcgcagtagtggtaatggtaatatccaaaccacgtacacgatcgactttatcgtagtcgatttccgggaagatgatctgctcgcgcactcccatgctgtagttaccacgaccatcgaatgacttagcggacaagccacggaagtcacggatacgaggtacagcaatggtaatcagtcgctcaaagaattcccacatgcgttcgccacgcagggttactttacagccgatcggatagccctgacggattttgaagcctgcaacagatttgcgtgctttggtgataaacggcttttgaccggagattgctgccaagtcagctgctgcattatccagcagtttcttgtcagcgatcgcttcaccaacacccatattcagggtgatcttctcgacccgagggacttgcatgacagagtcgtagccaaactgagacatcagttgtttgaccacctcgtctttgtagtaatcatgcagtttcgccatcgtattactccaaattacttgatagtttcgctagtcgatttgaagaaacgaacttttttgccgtcttcaaatctaaagcctacacggtcagccttaccggttgtcgcgttgaacagcgcaaggttggaaacttgaattgcagcttctttttcaacaatgccacctggttggttcagagccggaaccggcttctggtgtttcttaaccaggttgataccttcaacgatgaccttgccagaagacaggacattctttactttaccgcgcttacctttgtctttcccggttagcacgataacttcgtcatcacgacggattttcgctgccatggttcgctccttagagtacttctggtgccagagagataattttcatgaacttctcattacgcagttcacgagttaccggcccaaaaatacgcgtgccgattggctgctcgctgttattatttaaaataacacaagcgttaccatcgaagcgaatgacagaaccgtccgggcgacgtacacccttcttggtgcgcaccactaccgccttcagaacatcgcctttcttcaccttgccacgaggaattgcttccttgatggtgatcttgatgatgtcgccgatgcctgcgtagcgacggtgcgagccacctagaaccttgatacacattacgcgacgtgcaccggagttgtcggccacgttcagcatagtctgttcttggatcatgttagtgctccgctaatgtcaactactactttaggacccagaataggtcgtttaaaagccccactaatgagggcgcggcattataacaccggttccacatcctttgataggaaaaagtgggtagaaaaaataagcggcccattttcagagccgcttattatgttcgagttggctactctattacagaatcgctttctctacaacgcgaacaagcgtccaagacttagtctttgacagtggacggcattcgcggatttctaccacgtcgccgataccacattcattgttctcgtcatgtacatgcaacttcgtcgtacgacggatgaatttcccgtaaatagggtgcttcaccacacgttcgatagcaacaaccatggatttctccattttgtcactaactacgcgaccttgcagagtacggatttggtcagtcattacgcacccgccttctcagtcagtaaagtcttaacacgcgcgacattacgacgcacttgtttcaacaggtgagtttgttgcagctggccactagccgcctgcatgcgcaaattaaattgctcacgcagcaggttgagcagctcagtgttcagctcttcaacgcttttttcacgcagctcttgtgctttcattacatcaccgtcttagttacaaaggtggttccgacaggcagtttcgctgcagcaagcttaaatgcttcacgtgcagtttcttcaggaacaccagccatttcaaacaatacttttcctggctggatcagggcaacccaatactccacgttacccttacctttacccatacgcacttcgagcggcttctcagtgatcggtttgtccgggaatacacggatccagaccttaccttgacgcttaattgcacgtgtcatcgcacgacgggctgcttcgatttgacgagccgtcaggcggcaacggccacaagctttcaggccgaactcaccgaagctaacatccgtaccttgcgcaaggccacggttacggcctttgtgcatcttacggaattttgtacgctttggttgtaacatcagcgattctccttacttgcggcctttacgctgctgctttttaggttgagcagccggttccggttgttcaacagcagccataccacccaagatctcacctttgaagatccataccttaacgccgattacaccataagtggtgtgcgcttcagatgtgttgtaatcgatatccgcacgcagtgtatgcaacggaacacgaccttcacggtaccattcggtacgcgcgatttcagcaccgccaaggcggccgcttacttcaactttgatacctttagcgccaagacgcattgcgttctgtacagcacgcttcatagcacgacggaacataacacgacgttccagctgtgaagtgatactgtcagcaaccaattttgcgtccagttccggtttacggacttcggcgatgttaatctgtgcaggaacgccagcgatatccgctacgaccttacgcagtttttcgacatcttcacctttcttgccgataacgatgccagggcgagcagtgtgaatagtcacacggatgctcttcgctggacgctcgataacgatgcgagaaacggaagctttcgctaattccttagtcaggaattggcgaactttaaagtcgctgtccaggttgtcagcgaattctttggtatttgcgtaccaggtagagttccaagctttgacaatacctagtcgaataccattaggatgtactttctgacccattgctagtctccagagtctcagcgatcggacacaaccacagtaatgtggctggtgcgcttcaggatgcgatctgcacgaccttttgcacgcggcataatgcgcttcatgctagggccttcgtctacgaagatcttcgtgactttcagatcatcgatgtcagcgccatcgttgtgttctgcgttagcaatggcagactctagtaccttcttaaccaaaccagcagcttttttgttggtgtaggttagagtttccagagcttgcgacactttcttaccgcgaatcaggtccgctaccaagcgaaccttctgagcagaagaacgagcgtggcgatgtttagcgatagtttccatctcttcctcctaccttagcgctttttggcctttttatcggccgcatggccgcgataagtacgggtcggcgcgaattcacccagtttgtgaccgaccatttcatcggaaacgaatactggaacgtgctgacgaccattatggacagcgatggtcaaaccgatcatatttggaaagaccgttgaacgacgggaccaagtccgaataggcttcttgtctccgctttccaccgctttctctaccttcttcagcaagtgcaggtcaatgaagggacctttcttgagagaacgtggcatggcttatcctctaattattttttactacggcgacgtacgatgaacttatcagtacgcttgttgctacgggtcttcttacctttggtctgaacgccccacggggttaccgggtgcttaccaaagttacgaccttcaccaccaccgtgcgggtgatctactgggttcatcgccgtaccgcgaacggtaggacgaataccacgccaacgactagcacctgctttacccaggacacgcagcatgtgttcagcattaccaacttcacctaaggtggcgcggcaatcagcttgaaccttgcgcatttcgccggagcgcagacgcagagtaacgtaggaaccgtcacgagcaacgatctgaacgtatgcaccagcagaacgagccaactggccgcctttacctggtttcatttctacgttatgaaccgttgaaccaactgggatgttacgcataggcagggtgttacctgctttaattgcagcatcaacgccagattgaatctggtcaccagccttcaggcctttcggcgccaggatataacggcgttcgccgtctttgtacagaaccaacgcaatatttgcggaacggttcggatcgtactccagacgctcaaccacagcagggataccatctttgttgcgtttgaagtcaaccagacgataatgttgcttgtggccaccaccgatatgacgggtagtgatacggccattgttgttacggccaccgcttttgcttaatttctcaagcaacggggcataaggcttacccttgtgcagctcagggttaaccactttaacaacgtggcgacgacccggagacgtaggtttacatttaacaattgccattgtttactcctccgacttactctgcgccgccgatgaagtccagattctggccttctttcagggtgacgtaagcttttttccagtcgctacgacgaccaacacgctgaccgtgacgcttactcttgcctttaaccagcaaggtgttaacgtcttcgacttcgacttcaaacagtttctgcactgcagctttaatttctgctttggtcgcgtctttggcaactttgagaacgatggtgttattcttttccatcgcagcggacgctttttcagatacatgcggcgagcgcagtactttcagcagacgttcttcacgaatcatgccagcatctcctcaacttgcttcacagcatcagcagtcataaccactttgtcgaaggcgatcaggctaactggatcaataccggctacatcgcgaacatcaaccttgtacaggttgcgagcggccaagaacaagttctcgtccagttcacccgttacgatcagcacatcttccagagccatatctttcagtttctgcgccagcaacttagttttaggtgcttcaacagagaacttttcgacaatgatcagacgatcttgacgtaccaattcggacagaatgcttttcagcgcgccgcggtacatctttttatttactttttgactgtggtcctgaggctttgcagcaaaggtcacaccacctgaacgccagatcgggctctttacagaacctgcacgcgcacggccggtacctttctgacgccacggttttttaccggaacctgttacttcagcacgggtcttctgagcacgagtaccttgacgggcacctgctgcgtaagcaacaacaacctgatgtacaagcgcttcattgaaatcacgcccgaaggtagtttcggaaacagtcagcgcgcctggcgcgtctttcattaccaattccattcctatctcctcgacgttacgccttgacagccggttttacgatcaggttgccaccggtagctcccggaacagcgcccttgaccagcagtaggttgcgctcagcgtcaacacgtactacatccaggctctgaacagttacacgttcatcacccatatggcctgccattttcttgcctttaaacactttgcccggagtctggttttgaccgatagaacccggaacacggtgagacaaggagttaccatgggtagcatcttgggtgcggaaattccagcgcttaacagtaccggcaaaacctttacctttagacgtacctgtaacgtcgactttcttaacgtctgcaaaaatttcgacgctaatttcttgaccagcagtaaactcttgaccttctggaaggcggaattcccacagaccacggccagcttctacgccagctttagcgaaatgacccgcttctggtttagtaacgcggttagcttttttagcaccggtagttacttgcacagcacggtatccgtcgttctccaggcttttgacctgagttacgcggttcgcttcaatttcgataacagttactgggattgaaacgccatcttcagtgaagatacgagtcatgcccacttttttaccgactaaaccaatcattgtttcaacctctcaatcgctcaatgacctgattaacccaggctgatctgcacgtctacaccggcagccagatccagacgcatcagagcatcaacggttttctcggttggctcaacgatgtcaaccagacgcttgtgagtgcgaatttcgtactgatcgcgcgcatctttattgacgtgcggagaaatcagaacggtaaagcgctctttgcgagttggcagcgggatcggaccacgaacctgcgcaccagtgcgcttggcagtctcgacgatttccgcagttgattgatcgatcaaacgatgatcaaacgctttcaggcggatacggattctttggttctgcatgagaccagagctccaattatttataaacgtaaatgattactcctcgcacccatttcgattgatgggggagtgtaatcgttcaacatataacccccatatcgggagtattgttcagtgacaacactaggctgtaactgacagattagtttcaatctgacccaccaagattaggtaggcccgcgcattatacgtaaataccagcaggaagcaagctggtgttgaaaatctacgcaagaatttgccagataatttaattgaagggggaataagatgactgacaagatggaaaaagcggagaaagaagagtgagcgcatcgcgatactcactctttatcactaaaaatgtcattactgaaccaacgacgccattgctgagcaaacacgtgatctctaagacctagtcttttgctagctgggcctgtgagtagctttgtatacctaaacggtcgatcaagctaagttctgtttcgagccaatcaatatgctcttcttcatcaaccagaatttttttcaataaatcacggcttacgtagtcatggattgagtcagcataagcaataccttctcgtaaatctatagctccagacaactcgagcgctaaatcagatttcagcatttcttcaacatcttctccgatattcaatttaccaagctcttgtaaattaggaataccttcgaggaataaaatacgttcaatgtatttatccgcgtgcttcatttcgtctatagattcgtgatactccttatcattaaggcgcatcagaccccagtttttaaacattcgggcatgaagaaaatattggttgatggcaactaactcgtttccgagcagtttattcagatgtgcaattatctttttatcacctttcatagttataccctccgcttccagtactaacagtgtagtaccagatggcaaagtatgcggaaaacttctccgagctaactattaggcaacatcattcatttctggaatattagcgagttcctcaatcaagatctctctggcttgtcggatgcacttcccacagtcactaccaatcggcacaagctgtcgcagttgcttaactgtatggggctgatgctggcgcacagctttgcgaatgactttgtcagaaaccgcattacatagacaaacgtacataaaaagactcatttcttaaccagtcttttgagtgtaaataagaatgagttttatttcaattaagattattcactttatcaataaaaaagggtgccgaggcaccctttggtttgatcaataaataattaatcagaaaaattaagcgattactttagcaacaacaccagcgcctacagtacggccgccttcacggattgcgaaacgcaagccgtcgtccattgcgattgggtgaatcagggtaacaatcatgttgatgttgtcacctggcatcaccatttcaacgccttctggcaattcgatggtaccggttacgtcagttgtacggaagtagaactgaggacggtagcctttgaagaacggagtatgacggccgccttcatctttgctcagaatataaacttctgattcaaaggtagtgtgtggtttgatagaacctggtttagccagaacttgaccacgttcgatatcttcacgtttgataccacgcagcagaacaccaacgttctcaccagcacggccttcgtccagcaatttgcggaacatttcaacgccagtacaagtagatttaacagtatctttgataccgacgatttcaacttcttcgccgactttaacgataccgcgctctacacgaccagttactacagtaccacggcctgagatagagaatacgtcttcgattggcagcaggaacggcttgtcgatagcacgttctggttctgggatataagaatccaggtaaccagccagttcgatgattttagcttcccactcagcttcgccttccagtgctttcagcgctgaaccacgaacaactggcagatcatcgccagggaagtcgtaagcagacagaagttcacgaacttccatttctaccagttccagcagctcttcatcatcaaccatgtcacatttgttcatgaatacgatgatgtaaggaacgccaacctgacgacccaacaggatgtgctcacgagtctgtggcatagggccatcagttgcagcaacaaccaggattgcaccatccatctgagcagcaccggtgatcatgtttttaacatagtcggcgtgacctgggcagtcaacgtgcgcatagtgacgagcaggagtatcatattcaacgtgagaagtgttgatggtgataccacgtgctttttcttctggtgcgttatcgatttgatcgaaagcacgagcgctaccgccgtaggttttagccagaacggtggtgattgctgctgtcagggtagttttaccatggtcaacgtggccgatagtaccgacgtttacatggggtttggtacgttcaaatttttctttagacacgactatattccttactcttgtgctctcccactaatgagagagcactggatcattgttttaaacccgaaagcttatttgccacgggcttcgataacggctttagcgacgttactcggtgcttcagcatactccaagaattccatggagtaagaagcacggccctgagtctgagaacgcaggtcagtagcataaccgaacatttcagacaacggaaccttgacgcgaacagttttaccggtagcagtatcttccataccttcgatgataccgcgacgacggttcaggtcgcccattacgtcacccatgtaatcttcaggggtttcgacttcaaccttcatgattggctcaagcagaactggtttagctcgtttgaaaccttctttaaaggcgatagaaccagctaatttaaatgccaattctgaggagtcaacgtcatggtaagaaccgtagtgcagacgcactttaacgtcaacaactgggtaacctgccagagggccagatttcagctgttcttgaatacctttatcaacggccggaatgaattctttaggaatagaaccaccaacgatttcgttgacgaattcatacccaacaccacccggtggcaatggagacatgtcgataacaacatgaccatactgaccacgaccgcctgactgcttagcgtgcttaccttccacatccttaacggtttcgcggatagtttcacggtacgcaacctgaggtttaccgacgtttgcttccacgttaaattcgcggcgcatacggtcaaccaggatatccaaatgcaactcacccataccagcgatgatagtctgaccagattcttcgtcagtccaaacgcggaatgatggatcttctttcgccaaacgccccagagccatacccattttttcttggtcagctttggtttttggttcaacagcaacagagattaccggctctgggaactccatacgttccaagatgatcggattattcgggtcacacaaagtgtcacccgtagtcacatctttcagaccgatagcggctgcgatatcaccggcgtgaacttctttgatctcttcacgcttgttagcgtgcatctgtacgatacgacctaagcgttcacgttgcgatttcactgagttcagaacggtatcaccggaattaacaataccagagtacacgcggaagaacgtcaggttacccacgaatgggtcggtagcgattttgaacgccagagcagagaacggctctttgtcgtcagaatgacgaacagccggagtatctttgccatcatccaagatgccgttgattgattcaacgtcagttggtgcaggcaggtactcaataaccgcatccagcattgcctgtacgcctttgtttttaaacgcagaaccacaggtaacaagaataatttcgcttttcagaacacgttgacgtaaagctttcttgatttcttcttcggtcagctcttcgccacccaagtatttgtccatcagctcgtcagacgcttctgccgcagattcaaccagattctggtgccattcagcagccagttcagccatatcagcagggatttcttcatattcgaaggtcacgccctgatcagcttcgttccagttgatcgctttcattttcaccagatcgataataccggtgaatttttcttctgcgccaattgccaactgcagtggaactgggttcgcaccaaggcgagatttcagttgaccaactacgcgcaggaagttcgcacccatacggtccattttgttaacgaacgcaatacgtggaactttatatttattagcctgacgccatacggtttcagactgtggctgaacaccaccaactgcacagtaaaccattaccgcgccgtcaagaacacgcatggaacgctctacttcgatagtgaagtcaacgtgcccaggggtgtcaatgatattgacgtgatgtggttcgaactgtttagccataccagaccagaagcaggtagtagctgcagaagtaatggtaataccacgctcctgctcctgttccatccagtccatggtggctgcgccgtcatgaacttcaccgattttgtgatttacaccggtgtaaaacaggatacgttcggtagtggttgtcttaccggcgtcgatgtgagcgctgataccgatattacgatagcgctcaatgggtgttttacgagccatttgattcctctattcctagggcgttcattcggttaacccatgcgggttggcttcttgaagcgcccgcatggttagcatgactactgcgggatattaccagcggtagtgggcgaacgccttgttagcttcggccatacggtgaacgtcttcacgtttcttaacagcagaacctttgttctctgctgcgtcagacagttcattcgccaagcgcaaagccatggatttatcaccgcgtttacgagcagcatcaacgatccaacgcattgccaaggcattacgacgaaccggacgaacttcaactggtacctgataagtagaaccaccaacgcggcgagacttaacttcgacagtcgggcgcacgttatccagagctacttcgaaagcttccagaaaatctttaccagaacgctgagccagggtctccagcgcggtatagacaattgcttctgcagtagattttttaccatctaccatcaggatatttacaaatttagccagcaattcagatccgaacttaggatctggtaaaattttacgttggccaattacacgacgacgtggcatggaaatactccgttgttaattcagggttgtccaaaactctaagagtttattttgacattaatgtgaaaatgtttggccttacttaacggagaaccattaagcctttggcttcttcacgccgtacttagaacgtgattgcttacggtctttaacacctgagcagtcaagcgcgccgcgaacggtgtggtaacgcacacctggcaagtctttaacacgaccgccacggatcaggatcacggagtgttcctgtaggttatgaccttcaccaccaatgtaagaggtgacttcaaaaccgttagtcaaacgcacacggcaaactttacgcagtgcggagttaggttttttcggagtggttgtatatacgcgggtacatacaccacgtttctgcgggcatgcttccaacgcaggaacgttgcttttagcaaccttcatgctgcgtggcttgcgaaccagctggttaatcgttgccattattaaaaaagctcctggttttttgcttcgtaaacacgtgataaatccccctcgtttgcactactggcagagaacgaggacgcagaattttatggctgactatctaaggtgtcaagaaatatacagcattactcgcattaccatgccagttgctgctgatgtcttagggtcaaatccacgaagtgagtatagctgattagtgttgcgttgtctgaaatttggccaaccaagccacgtgcaataacatcgtcttccaatacaaatagagaagcggggttatttaacaacagcttaagagtttcactctctttcaaggccgctatcacaccatcttgcagcaacaaaatatcatcctcagatgtcgctaatctcaacagcgcagataaatcgcagtgataaggtgaatgactgacggtatacagcattatgaatacccaaacctcattaaaaagtcagcacaacatcataagtgcccagttcacggcgtaaatctgccggggataataccgttacatcgaggatccagtcagccattttactcaacccacgctgttgcaatgagcgttcacagagataacaattttcgacatcgtacagaggtaagacaccgaaagtagcaatatagtttctggcaagaattttttctggctgttgctgaggtaaaagttgcaaaacaccatctgagataaagaatacgccgatatcttcgctcaaagcagaggtggccagcaaagcatccaacccttcacgtccagctgagctgccatgggggccttgagtaaaaataaaagcgatgcgttttcttgccattaaaattgcaccatgcgatcacaagtcaacgtagcttctgccagcgcccctagaccactcaatgtaaaaccgggttgcagattcgcagcggccaaattgagttgctcggcttcatgttgatcggtaataccacggcgtagcgctgccgcgacacacacattcagcgtaaccgcctgttcagccgccaattgttgccatgctcgtaccagatcaaattcatcactcgctggggccgtgagttggttggcattcagtacgccttcgcgatagaaaaagatgctgaccaagtgatgccctgccccaacaaccgcctgagcgaactgataagcgctactggcctgctgtgtaccataagcaggccctgtgaccaataggcaatattttaacgcggacattaacgttcgtgcccgacgagatcgccacttttgaactgacgaatgtaaagatataccgtgtgctttgagatattgaggcgttctgcaacttggtttatggcatcttttatatcaaaaatacctttttcataaagattgagtacaacctggcgattcttggcgttgttagaaacgttacgatccgcattcacttcttcaatagtgaactccagcgtttgcgcaaccagatcatcgacagatgaagcaaagttgacggaggaaggcacttcttgtgtttctggtggcataaaagtctgaatgatttgtgagaaaggaacatccagattcatgttaatgcacaacaaaccaatcacccgctggtcacggttacgaatagcgattgtcactgatttcatcaggacaccgcttttggcccgcgtgaaataagcttttgaaacactactgtcagcaccagccatatcatggagcatgcgtagtgccaaatcggttataggcgagccaatctgccgccccgtgtgttcgccgttagcaattctcaccgcagaatttttcaaatcctccagtgagtgcaaaacaatttcacagtgcccaccaataagcattgccaagccatccacgacaacttcgtatgactttagtatttcatggtccgtctgactgaacggacgttcatccagtaaatccagttcactggtttcgctacagagaagcgaattagacatcgaagacaccatcctctacgtaaagcctgtctctatatcgttggcagactaataactcaatatcttagattttaagtctagcaaacatgccagtgtaaaatccttgcgtttacatgtggtattgacgttaagcccacaagctataagccgtcaagttatcaacgagcagataagtaaattgccagcgcacaaaaaaaaaccgtcacgacaattatcgtaacggttatgagaagagtgtgctgactaagtcaaattacttcttagcttttgtatcaactgcaggctgttgctcttgagcatcggctttagctgcggctttcacatccagcagttctacatcgaatatcagagtagagttggcaggaataccagggacgcctgctttgccgtaagccagttctggcgggataaccaaggtgattttgccaccttttttgatttgcttcaggccttcagtccagcctgggataacgccatccagacggaaagacaatggctcgccacgtttgtatgagttatcaaactcagttccgtcagccaaagtgcctttgtagttaacgacaacagtatcgctgtcttttggtgcatcacccgtaccggcgttctctaccttgtacagcaggccagatgcggttttcttcacacctttttctttagcaaaggtatcgcggtacttagcgcctttatccgcgttttctttggcatcttgctccattttggcttgagcagacgcttttacccgagcttcaaaattttgcagggttttttcgatctcttcgtcagtcagtttgcttttgttagcaaaagcatcttgcacaccagcgatcaactggtctttatccaacttaatccccaatttttcttgttctttcagggaattatccatatagcggcccaaagacgcacctaatgcataagcagattgctgatcattatttttaaatgcgctattggttactactggtgaggttgcgtcagcagcgaaaacagttgaggtattcagggttagcgtcatggccgtagccagcaacgttactttaaacagtgatttcatccatttctccattggcttaaggactctaaccccaagcaacgattataagagtaacatgtactataactgtgtgtgtgaacacaaaacaatctcaatactcatgctattaagtgatattaagactttttttactacaagaagtttcgtttttatatatatcttgacccttgcggggtaatcacggtgatttacaggtaatatcatgcccccagctatcgcgatatactgctacaaccgtaaaaaatggcccaaccgtatagtttgcagctatattatttatagctacatcgtttgcagtaatgagaggaaatacgatggaacaatccctgcttgaacaacggctagaaatgctggaaagccgtctggcatttcaggaagtgacgattgaagaacttaacttgattgtaactgagcatcaaatggagatgaccaagctgcgggagcatctgcgtttactgaccgataaactgcgggagtcccaatcgtcaatgctggcgtcaccgtcagaagaaacaccgcctccgcactattgattgatcgattgatttgtaataacgattaattagttttaataaccattaattggttttaataaccattggttacccccaaatcgcggctgattaattttaatatccgcaccgctagcggcagttatgacgagatcattggctatcacacagaaaatgagtgatcgcgtacagagtaaaaagccagcgatgaaggctggctttttgctgacggggtcagatattagtgacagccacaaccgccacttttaccgcaaccacctttaccatgctcatgttcatgttcatgttcatggtcgtcgtggccgtgaccaccgcagcaaccgtcaccgtgttcatggtgatgatcatgctcaccatgtacatggccgtgctgcaactcttcttctgttgcttcacggacagcaaccacttcaacgtggaagttcagatcctggcccgccagcatgtggttaccatcaaccacgacgtgctcgtcttcgacagcagtgatctcaaccggtactgggccttgatcagtatctgccagaaaacgcatccccacttccagctcgtcaacgcccataaagacgtcttttggtacacgctgcaccagattttcatcgtagctgccgtaaccttcatcggcattaacacgcacatcaaaactgtcaccagcttcgtggccttcgagcgcgttttctaaaccagcgatcagggaaccgtgcccgtgcaggtagtccaacggcgcgctcaccggagactcatcaactaaaacaccgtcttctgtacgtacctggtaagccaggctgactaccaagtcttttgttactttcatgatatctcctacccttggaacaaaaattggcacagattgtagcggaaatctgccccgctgtactcacccgcataaaaaatcacggcagataacgctactctggaggaaaaataccgatcacttgctcatgtggacgaacatgtttattgacctgttcatctgtctggcgttgatggtgaccacacttaacacactccactacttcaacctgatcctcacgccataaagccagcgtatccaaggcattacattgcgggcagacggctccggcaataaatcttttacgtgtcactgtcttattaagagtgatagtcatcgtttgtcctcgacattattcgtattcatcccacccatctaactgccggctttcatgtagcatttctcgttgaaaaatatcttccaactcacggcgagcttctttaattctggaaatttgtgccacatcgccatgatgttgtggcatcagctcacgtagcattcgcatgtccaagcgacgaaaatgttgttgcgcccggtaggcctgatgtggatgcatgcccagttccaataatgtcttacgccccagttccagcgcactggagaaggtttcacgcgtgaagtctttgaccccgttttggagcagttcatgggcttcgacacgccctctggcgcgagcaagaatgtgcagattagggaagtgttgctggcataaatgcaccagcgccatggtgtcttccggctcattgcaggtgataacaatggctttggctttttctgcgccagcggctcgtagcagttccaactcggtcgcgtcaccatagtaaactttgtagccatatttgcgcatcatactgaccgcgctgacatcacgttccagtacggtaatgcgcattttgttcgccatcaataaacggccaatcacctgaccaaatcgcccgaagccaacaataatcacctgtgggtcattatcttcaacaaagggtttttcatcactctcttcctgcgcgttgtagcgacgaaccaaaatacggtcaataacctgcatcagcaacggcgtagtcatcatcgataaggtgacgaccaccaatagcaatgccagttgttctgcattcaacacacgctgagagaacgccgcggaaaacaggacgaaagcaaattcgccgccttggctgagcacaccggcaaattgcaaacggaccgaacgccgcaagccaaacacccgcgccaaaccatacaagatggcacttttgataaagaccagtgccaagacgcccagcagtacatccagtaaatgggtaaacagcacgccgaggtccaatgccatgccgacagaaataaaaaacaaaccgagcaagagccctttaaacggctcgatagcgatttccaattcgtgctgaaactcactttcagccagtaatatcccggcgataaatgtccccaatgccatcgatagccccagggcatccataaacagcgcggaccccagcaccaccagcaatgccgcagcggtaaaaacctcacgtaccccagaggcgacaatgtagcggaacaacgggcgcaacaaataacggcccccaatcaacataccggcaaaagccgcaattttgaggccaatcttgacccagtcattggctcccccctcgttacccgccagaataggaatcaaggctaacgcggggatcaccgccatatcctggaacagtagaacggaaaaaccgagctggccgccttcattgcggttcatccccttttcccgcatcagttgcaatgccatggcggtagacgacatcgccaaacctacgccaccgataaccgctgcctgccaggcgaactgggtaaaataaagcaatgcgcccagtaccgcggccgttatcacgacttgaccagcaccgacaccaaaaatagatcgccttaattgccaaagttttgcgggattcaactccaacccaatgataaacatcaggaagacgacgcctagctcagaaaaatgtagaatttcgtcaacatcgcgaataaatcctaacccccacgggccaatggcaatacccgcgatcaggtaacccagtaccgcaccaatacctaagcgttgggcgatagggaccgcaacgacagcagcgaataaaaacactagaacagcggtaagtagccctgtgccctccataaatcagagtcctctcgtgagcggtgactgcagccattgcacataagcttgtgcgtgactggcgagtgtttccggcttttggcgtctggcccagtaaataatcatcggattaatccaatgcatatggcacatagccgccgtcaattcgaaaggacgcagaatgtcttccattgggtaacggttatatcccccaatacggtaagttccctcctgctcaccggtggtaatcaccgagcgccagtgctttcccgtcagtgcatggccgccaacgccattggcgaaaccacgtgccagtacccgatccaaccactctttcagtaatgcagggcaactgtaagtatataaaggatgttgaaatacaataacttgatgatcacgtagcaattgctgctcatgatgaatatcaataaagaaatccggataatgtgcataaagatcgtgcacagtgacatgttctaactgctgtaccggttgcagtaaaacccggttagcgaccgagtcctgtgattccggatgggcatacagcagcaaaaccttcggcggctgcaacatcattcccctccaaagcgtcgtcagggtccggtttttccgttaccatgcttcgcaaagactaaaaataggacaccaatcgtcccgtttatacccaatacccaacgtaattggcattgcaggtaggtcgccagaaaacaccgctaatgagcttactcaagtcagtcattaggatgagtgaacgtggctaacccctgtaacttcaagtgcaaaggggatgataatttaacatatcctaaacatacggcactctatgattgttttttcctcgcttcaaattcgacgtggtactcgcgtcttgctggacaacgccacagctacgattaaccccggtcagaaagtcggcctggttggcaagaacggttgtggtaaatcgactctgctggcgttgctcaaaggcgaactgagcgccgatgggggcaatgtcacatttcccaataactgggcactggcctgggttaatcaggaaaccccggcactggatatcccggcgatagagtatgttatcgacggtgaccgcgaatatcgccagttggaggccgaacttcaggctgccaatgaaaaaaatgatggccatgccatcgcaaccgtgcacggtaagctggatgccatccatgcctggactatccaatcgcgtgcggccagtttgctccacgggctcgggttttctcaagaaaaactacagcaaccggtacgttcattttcgggtggctggcgtatgcgtcttaatctggcgcaggcgctggtttgccgctctgatttactgctcttggatgaaccaaccaaccacttggatttggatgccgtcatctggctggaaaaatggctgaaaagctacaccggtaccttggtattaatttcccatgaccgcgatttccttgatcctattatcgataagattttgcatattgaacagcaaacgctgaatgaatataccggtaactattcatcgttcgaacgccagcgcgccaccaaactgtcgcaacaacaatcgatgtatcagcatcagcaagaaaaagtggcgcatttacaaagttatattgatcgcttccgggcgcaagccaccaaagccaagcaagcccagagccgtatcaagatgctcgagcgtatggagctgattgcccctgcacatgtggataatccgttccacttcagttttcgtacaccagaaagcctgccagatcccttgctgcgcatggataaagtcagtgccggttacggggaaaacaccgtcttacagtccattaaactcaacctggtgcccggttcacgcatcggtctcttggggcgtaatggtgccggtaaatcaacgctgattaaattattggccgggacgttagaaccgcaaagcggtgagatcgccctgtccaaaggcattaaactcggttacttcgcccagcatcagttggagttcttacgggctgatgaatcaccgttgcagcatatgagccgcctggcccctaaagagtcagagcagcaattgcgcgattatctcggtggttacggctttcagggcgatcaggtgaccgacccaaccgcccgcttttccggtggagagaaggcgcgtttagtgctggcactgattatttggcaacggccgaatctgttactgctggatgagcccaccaaccatttggatttggacatgcgacaagccctgaccgaggctctgattgattttgaaggcgcattggtggtggtttcccatgaccgtcatttactgcgctctaccaccgatgacctctatctggtgcacgacggtaaagtggaacagttcgatggcgatctggaagattatcagcagtggctggtggattcacagcgccagcaaagccaacaggataatccggcgaaggagctatcgggcaacagcgcacaacagcgtaaagaccaaaaacgtcgcgatgctgaattccgcactcaaacgcagccactgcgtaagcagattatgacgctggaaaaacagatggataaactcagcactgagctggccgctatcgaagcacagttggcggattcagcactgtatgatattgcgcgcaaagcggacttgacccaatgcctactgcaacaaacgcaagtgaaatccaagctggaagagacggaaatgcagtggttagatgtgcaagaacagcttgaaatactgactaaagagtttagcgatgccgatatataatatcggaaatatagatataacatcgcgaatgtaaatatggcatcgtgaatatagtcgtgcgaattgagttagagtcgcacgactagagcggcgtgatttttcgcggtcttatcacgcccagagattaaacaatcatgaacagcgttgatatcagcgtcattgtccccgtatacaattgcgcaaattatcttacggatctgctcgactcactgcgcagccaaacgggcgtctcgcttgagattattgccgttaacgatggctctaccgatcacagtctcgcactactggaacaggttgctcatattgattcccgattagtgattataaatcagcagaatcaggggctttctgaggcccgcaatgtggggatcgccaaggcgaaaggcaattgggttgcctttgccgatggtgatgattggctggcaccccatgccctgtcaacttggttacagcaggttaaacagcagaagctggatgtcttgattggtaacggctatcaatttagcagtaaccccgagcgaaaaccggtcacccccttattgggtcaacagccttggggagcgacgctcaatggtcaacaatggattatcctcagtgttaaacaaaaagagtggccacattatgcctggttgcaactgattcgtcgcgatgtgatcagcactcaccaattacagtttattcgcgatatgcttcatgaagatattctgtggaccacccaattagcactcgtggcccaacgcatcgggttctgtgccacgcccttctatggctaccgtactaatcctgactcaatcactaactctccctcaatgcaggcactcctacgccgcgccagtagctacgttgatattatcaacgcactggttaagattgccgccagcaccaaaccaccggtgcgcgatgccttgctatctcatgccaatcaagaaagtggccatcttttagggttattacgtaaaaaactacctacctcaccacaacgtaccgcattggcaattcgctttatcacattgggtctgcgccctgcactattccgtggtgtaaccaatctccatgaactctggcgagcaatacgttgctcattcttgatgggttcctatgcccggcaaaagcgcgctgaatgaataagttacaaatacttattcattacactgtatttccctggcacatataaggtttaattaagccctgaagcaattaatgtgaatggacttaaatgcagcgtatcttggtgatccgaattgattttctcggcgatatggtttgtaccacggcgctattacatgcgctgaaacaacgttggccagcagcagaaatccacgtattagcgaataaatataatcaatccgtgctgacacgtaatcctgatgtcagtgcggtccacacttatgtttacagcaaacaatgtgagagaaacccgcggccaggccggctcatggccctttttgatcggctagcattaatttggcggctacggcgtttaggcttcgatctgctgctcattcccaatggtggcatgaacaaaaacagtattcagtttgccaaacagctcaatgtggcagatcgccgttggcatacggctgaaactgaatttgacgaccgtaatcctgaacatgttgccacgcggccaatccgtcacgaagccctctcgggatttgcactgatgcctgaactggggcgggtggacatcgaaacacttaagctgcatgtctacccagagccacaattgcaggcaaaatggcgggccgatcttggggaaaaagaccggccacgtgtcgggctatttatctctaataaatccgcccaacggcgctggagttgggataagtggcgtcaattggcattgaaactcaatgcacaggctgaattgctcatttttcatgatccagcagaacaaccatccgagcagcaattagcggggctaaccgcccgttgtctgtcaacgccatccactgacgacctgatggcggcgatgagccagttggatttggtgatttccgccgacagcgcaccggtacatatcggctccgcattacaaatacccgtggtggccttgtttgaatcccggccagagaagtacctacgctggtatccgctaggtgttcgccatgtgctcgtccatgccgggccacaagttgaagacatccatgttgatgctgtcgagtctgccgcccgttcactgttgaccacagattaataacgccatagatcagggccggaacaccggcctatcacccagaatcgtcgcccgatgcatcacccgccgctgcggtaggtagtcggcattggcgtaatgctgtgtcacacggttatcccaaatagcgacatcatcttgctgccagcgccaacggacctggaactccggtttagtggtgtgagcgaataaaaaacccagtaatgcctcgctttctttatcactcaatccgattattcgagtcgtaaacccttcgtttacgaataatgcctgacgcccactcaccggatgagtacgtatcaccggatgcagtaatggcgggttcttctcttttccctgtaaccagcgttgatgctcttctggcgtggtgcggtgcttgtgttcagggaaagatttagtgaaatcgtgttcggcctgtaacccggccaatagctgtttaaacggggccgaaagcgcgtcataagcggcaattccgctactccacaaggtatcaccaccggttgtcggcagttgtttggcggctaaaatcgcccctaatggcggcgtttcgataaacgtgacgtcagtgtgccagttgtcattatccggtgggttatcgtcggcggtatccaaaacgataatttcttcacactcttgggtatgcggataaaccgggtgaatatgcaaatcaccaaagcgcccggccaggtctcgctgctgtaacggtgtgatcggttgattacggaaaaacagtacctgatgtttgagcaacacatgataaagctgttcaaactggctatctcccaacgggtgcgcaatattaatattttcaaccagcgcaccaatatgcggccccaaaggcgtcacaatcagacgttcattcattgttgttctccataccaaggcgttaaccggcgttgaatcgcccgtaaacttaactccatcccaaaagcaataatggcaatcacactgataccggcaatgaccacatctgttgccaaaaactcaccggcggattgcaccataaagcccaatccccgtgtcgcggcaatcagctcagcggccaccaaagtggaccacccaacccccaggccgatgcggataccggttaaaatctccggcaaggcgctgggcaacaccacaaaccataaaacctgccaacggctggcacctaatgcacgggcggccctcactcgaacgtgtgccacgctgcgcacacccgcaaccgccgccaacgtcactggcgcaaatatcgccaaataaatcagtaggatttttgaggtttcgccaataccgaaccagataaccatcagcggtagataagccaacggcggtaccggacgataaatctcaattaacggatccaacacaccacgaacgttactgttcagccccatggcgatcccggtagggacccccagtaccactgccgccaacaacgcaacgaaaattcgcccaaggctagcagccagatgctgccatagcgtggcatccataaacccttgcgggctggcaatggtccatagctgatgcaaaacctgctgtggagcaggtaaaaataacgggccgataagctgtaacgccgtgactgcccaccataaagccaccaccgaagccaacgtggcgatactgatccacagcgtctgattggcaggtaaacggcggggcgtttttttcggtgcatctgcagcgggcagattaatcgcctgattacgtaacgtactgtgcaggctcatatcaacacctcccgctgttggaagactttacccaacacgtattcacggcgggcgataaattcaggatccgacttaatagcacggcaaggttcaccctcggcatagcgttgaccaaaattcagagacaaccgttcaaccacctgccctggccctggcgatagcagcaatagctcactggccaggaaaaccgcttcttcgatatcgtgggtaatcagtaaaatttgcttgccggtatcacgccagatggtcaacaacagttcttgcatctgctcacgggtaaaagcatccaacgcaccaaaaggttcatccagtagcaataaacgcggatcgacagccagcgcacgggcaatccccacccgctggcgcatcccccctgagagctgccagatgaagtgatgttcaaatcccgccaatcccacccggtttagcattttcagggcggttacccgccgctgttctttactcatccccgccagttgtaggccaaactccacattactgaccacatcacgccacggcaggagcccctcattctggaacaccacgcctcgctcggcactcgggccactgaccgggatattatccaacgtgataacgcccgctgaaggggtcataaaaccagcaatcaaattcaacaacgtggttttaccgcagcctgatggccccaagaccacaaccaactggccggatgctatctgcaatgacacatcctgtaaggccggttttccttgatattcggcccacaggccactcacgttcaacatgatggctcctaggattgcggtgtcgcctgggattgcggtgtcgcctggatttcttttacaaaacggtcagtgacaaaatcacggtagtcactggcaacttgagggatcttgccttgctgcttaaggaactctgcagtatcgcggatagcctgatccaccggctgacctaattgcgttatctgttcagccactggcaagtaagtattgccttttaccagcgctggaacttgctcggtgggcacaccactcaagcgagagagtggggctaaatgcgcttgattttgcaaccactgttcagggttgttcagataagcggcttgtgctgccaatgcactgcgggcaaaggcggtaacaacttcaggatgggctttggcaaagtctttgcgcactacccatacatccaatgttggtgccccccactggcccacttgggctgaatcggttagtaccgtaccggttttggctaattcactcacggcaggtgcccaaacataagcgccgtcaatatcaccacgctgccaggcggcggcgatagccgggggttgtaagttgaggatggtgacttggcccggtttaatcccccaatgcttcaacgccgccagcaagctgtaatgggcggtagaaataaacggcacagcaatacgtttaccaatcaaatcctgtggcgttttgatctcttttttcaccaccaaggcttcagagctacccagttgtgaggccagaaggaaaacttcaatcggtacattttgactggcagcgacagccagtgggctggagccaatattaccaatctgcacatcaccagaagctagcgccctgacaacgctggaaccgctatcaaatttgcgccaatccgcgttggcaccagagagtttggcaaaactgttatctgcctgcgcgacctttgccggttcagcagaggtttgataagccacgatgacatcgactgcctgcgcgctggtggcgagcagtaatgaagctggcagtaacgaggccaataaaatcgtgcggagttgtaaaaagctgcgtcttgaagcggcaagggttgccgaagaaaaagttatcgccatggtttactgactccgcttggttaactgcgtcattaaggactgggcgcaagcgccctgaaatgacagtgttacccgagagagagagcagcataaaggaataaaagaatattgtttattcctttatgcgataacagatgtactaaaaactttaccggtatcggtaactggctgttaactcaagcgcaacgtcacctttcatgcattaatgccagatcagtaaaacacacgcggcggtcagcaggcccattgagatattaaaggtaaaccaagcacggcggctgccgagcaggcggccaatcagggtgccaaaacccagccaaataatccctgccaccagattcaccataaacatccccaggcttatcatcaagatggagtgattgtaggctgcgcccgccatgctgaaactggctaccgagcctaaccccatcagccaggcctttgggttaagaaattgcaataaccaaccctgatacaaacgtagcggtttggctggggccacattggtgtctaatttttcataggctgaagtggcaattttccatgccagccacagcagatacaaactccccaaaattttcaatgccagatggagggaggggtagatcaaaatcaggctacccacgccaaaagccaccagcagcagcatactctgcatacctaacataatgcctaacatcaaccagatagagcgcataaagccgaagttagcacccgcagaggtaagcaacatattatttggaccaggggtaatagccgcgacccagagaaaaccaaccattgacagaaataaactcaattccatgagatgggtgcctctcacccaaaatgatgcgcgatatacccatgaagctaacagtgtgctattgatcacacaagagcaatcacatatatcccattcagattatgcatgagacatttcgcccgctggcaggggccagcaacccacacttgcagacattgctgccgcgcctggtcaggcggcatgtgcaactatcgccctattggcaacggctggaattaccggacggtgattttatcgatttagcttggagtgagaaccccgagttggcgcgcgagaagccccgagtggtgctcttccacggtttggaagggaatttttacagcccttatgcccacggtttgctacgcgcctggcaagctgcaggctggctgggtgtggtgatgcattttcgcggttgcagtggtgaacccaatcgtaagtcgcgcatttatcactctggcgaaaccgaagatgcgaattttttcctacattggttacaagaaacctatggacaggtgcctaccgccgccgtaggcatatcattaggcggtaatatgctggcttgctacctggccaaaaaggggaagaatagcggattgcgcgctgcggtggtggtttcggcccccttaatgctcgaaccttgtgctgaccgtatggaccaaggtttctctcgggtctatcagcgctatttattgaatcagttaaagctgaacgcgacccgcaagctattacagtacccaaatagcctaccggtgaatttattccagttgaaaaaattgcgacgagttagagatttcgatgatgcaataacagcaaaaattcatggatttaatgatgcaggagattattatcgccgttgtagcgccctgccactgttaccgcaaatccgtgtcccgctgctgattattcatgccaaagacgatccgttcatgaccgccgaggtcattccgaatatcgagacactgccggacaatattgattatcagctcactgaacacggcggtcacgtaggatttgtcggcggctcgttaaaacatccacaaatgtggctggaacagcgaattccagcctggctttccccctatttggagcagcagtcatgatcattccctggcaacaagtggacagtgaaacactggataatttgcttgaagcctttgtattacgcgaaggcaccgattacggcgaacatgagcgttcactgacagaaaaagtcgcagacgtgcgccgtcagttggtcagtggtgaagccgttctggtctggtccgagttacacgaaaccatcaatattatgccccgtggttcattccatgccggtgctgaagagcagcaataattcgtactctttcaccacggcactgagtgaacagcacaataaaacaagatgacaagcccgtctctttgccctaaaaataaccactaacaacaaaaagaataggcaatggtcagtgccgccactgcaaccccatggagttagcgctaatatgtcaactaaacatccggttatcgccgtcactggctcaagtggtgcgggtacgaccaccaccagtctggcttttcgcaaaatttttcagcagttagatattcgcgcagcacagattgaaggtgacagtttccatcgctatacccgcccagaaatggatgccgccattcgtaaggcgcgggatcaaggcagacatatcagctattttggcccagaagcgaatgattttggtcagttagaacaaagcgtggcggaatacagcaaacacggtactggccgctcgcgtaagtatttacatacctatgatgaagcagtgccttataaccaaatccctggcacctttactccttgggagccgctaccggaacccacggatgttttattctatgaagggctgcatggcggggtcgtgaccgagcatcatgatgttgcaaaacatgtggatctgttggtcggtgtggtgcctattgtcaatttggagtggattcaaaaattagtgcgggataccggtgagcgcggccattcccgtgaggcggtgatggattccgtggtgcggtcaatggacgattacattaactacattacgccgcagttttcacgcacccacattaactttcagcgtgttcccaccgttgatacctcgaacccatttgccgccaaagctattccctcgttagacgaaagtttcgttgtgatccatttccgtggtttggatcacatcgatttcccttatttgctggcgatgttacagggttcatttatttccaacatcaatacgttagtggtacccggagggaagatggggctggcgatggagttaattatggctccgctggttcagcaactgctggaagggaagcagatcgcttaactaataataaacttcggttttttctccaactaatcccgtgtttgacgaagtgtttggccgttgatgctcatttaaaatactcatttttaagtggcatcagcgtagccgttaaatatcacttttatgacggcatcgagtccgttaaaaaattcatctttaacaacaaccaagctttgcctaacggcataatttcaggtcgattacatacttattgggcgcgataaaagatttcctttcgcactttaaatacccagcttcttttaaagaagaatccacataaaaagaaaaaaacagactaaaaaccatccccagaacagctatgtacgcaagtatcttaccgacacgatcattatatattttttcatatccgatgatatacccaccagagaccacagataaataaaataataatggtgaaccagataacaacaaagatacagcccaagagaaatgcacttcatcattcattttaaaaaaattaaaataatgagttaatgagaaaaacaaagaaaatgaggcgacaacaaacaatgatatcgccccacaggcaaccgatattttgtttttattagccacgactgtataccccccaagtattaaatatttcatctggatgaggtgagcgctgttattttggcctaaaaacccataaccaaaccgggctatgggtggttcaccatttacgcgacttcgcgtacctcaaagctgtgggtaatggttgcggctttccccaacatcagagcaacagagcaatatttttcggctgatagatcaactgcgcgctccaccactttgtccgttaaccctttaccgctgacgataaagtgcaagttgatttgagtaaacagacgcggggcttcttcccgacgttctgaggttaatttaacctcgcaatcccgcacattgttacgccctttttgtaaaatagacacgacatcaatggcgctacacccccccgctgacattaatagcatttccatcgggcttggtgccttatcacccgaatttccatccatcaaaacttgatggcctgacgcggattcgcccaaaaatgttagcccctcaacccacttgacacgtgcttgcataacgcctgctcccggttaaattttctaatttagactaccctttcatttacaaagtggcaatgtaactggacgttcatcatgctgaagcgatacaacacaagacagtagcctcatcctgtgctacaaacagaatcgaaagtgatgctgtagcaattaaattagagtagagatcaatactcagtgaagggtttctattcggtacgaaccttggctatacctttcggcagttgagcaagttaatatgctaaaaagaaagtgtattctataagcacgccgtacagggaactctgagccctgttaagttaggcagcgataacaacagaggataacagcgaatggttctcggtaagccacaaacagacccgactctcgaatggttcctgtctcattgccatatccataagtacccatccaaaagtacgctgattcaccagggtgaaaaagccgaaacgctgtactacatcgtgaaaggctccgttgcggtgctgatcaaagatgaggaaggcaaagagatgatcctctcctatttaaaccagggggatttcatcggcgagcttggactgtttgaagaaggccaagaacgcagtgcttgggtgagagcaaaaacggcctgtgaagtggctgaaatttcttacaaaaagttccgtcaactgattcaggttaatccagatatcttgatgcgcctctcttcacagatggcgaatcgcttacaaataacatcggagaaagtgggtaacctcgctttccttgacgttactggacgcattgcacaaacactgcttaatctggcaaaacaacctgatgccatgacccacccagatggaatgcagatcaaaattacccgccaggaaattggtcaaatagttggctgctcccgcgaaactgtggggcggatactaaaaatgctggaagatcagaacttgatctccgcacacggtaaaacgattgtcgtttacggcacccgttaattccctctaaaaaccggcgctaaggctgaagctattagcgccggtttttcccgttttctgtgagtaataaatttctggggcctatatgaagtggcaacggcttatttatcatcctgaagttaactacgcactacgccaaacattggtcctttgcctgccggcagcgctggggtttgccatcggtgatttacggcttgggttgatgttttccctgatacctgcctgctgcaatattgcttccctggatacaccgcaccaacattttttccgacgtctgattattggcggcgtactctttacgctaagcagtttcctgactcaacaactgttgctatggcatatccccttgcctgtgattatgctcggactggcattgatagtgggtgtcagcggtgcgattagcccactgaatggccgtctacttcccgcggtcttgatcgctgccattttcagtctcagcatggtgggccgcgcccctatctggcaggcacccttgctctgtgccgtggggacgctttggtatggcgtatttaactggttgtggttccggttatgtaaagaccaacctattcgcgagccactgagccagctttatcatttattggccgattactgtgatgctaaatacagccggcttacccagcatcttgaacccgaaaaagcgataccaccgctactcgatagacaacaaggaatgatggataaagttaatcagctttatcaacaatttaacttgttgcacaacaccaccaagaaagagcaaaagcgtttgttgggactgtttcagatggcgctggatttacaagagcacatcactgcagcgctgaatcagccagaagaaatgcaagagctgataaaaaagacgcccatagaagcggtgactcagagtaatgcgcaaattatttcagcccaaatgcgcgccattgctgatgacattctctatcaccgccgcaccgtagaacacttcaccgctggtgtccctttagccgagctggaaacgatcgcacagcaaaatcccgacaacccggtggcacaattttgttactaccacattagccatatcacccaaatactgagcgaccgccgtccactgtataaccgcgacttgatgtccagtcagttgtcgcaacctttttggcctgctctggtaagttatttgtcgtttaaatccagtgcgctacgagatgccgcccgaataggagtgacactggccgtaggcagttatattggtgtattgatcaacctccccaaaccctactggattttgctcacaataatgttggtgatgcaaaacggttataacgccacgcgggtgcggatccatcaccgtgcgttgggcactctggtagggctgatactgacggcgggcttgctgcacctacaactgacagaaatcaccaccctcggcattatgttactgatcacactgctgtcttatttagtacagcgtaaaaattatggtctggcggttgtgggtagaacgataaccgccgtgtatatcgtgcagttattgaccggggaaggcgctaactttttagtcccacgtctactggataccttaatcggttgtgccttggcacttggcagtgcgttatggctttggcctcagtggcagagcgggttgttgcgtaaaaatgcccatcaggcactggaggcttatcagacgatcctgcgtttgctactgacccctcatcctgacattacgcaattagattatgagcgttttaacgtgaataaggccagcaacaccgttttaagttcactaaatcaggcaatgcaagagccgggattcaattcaaaatatttggcagatatgcgcctttgggccgcccatggcgagttgattgtttgccatatcaatgagatgacaacgctgatcagagagaatccattgactgaggtggactcaccatcaaccaatggtcatccactcatgagcactaaactggccgcaagctatttacagctatgtgagatggccatccagttgtgccaacaacggctggaatcggataatcttgaggacaatgatagcgtcgttcagatacccgatatggctccagatacccaagcctcagagctagaacgtaatttacgcagggttttatcacacttaaacgtgatgcataccgtttctgccatggcatggcaacagcagccacatcatggcatatggcgcagccggaagttacgggataatacgtaaaaagagagaggctagcgcctctgaggttattgacaaagtgcccgcgacggagagaacaggcagatcgtaaagacgccgtaaatacatccatgtaggctcgagccgcgccatccttggcgcggacgctttactcctctgcctatcctcaccattcaagatcgcgtcatcggggtttgtcagcagtctgagaggctagcgcctctccataacgcggttattggctgcttaacctttgatcacactcgccattgctttctccaaccgcgccatcccttgctggatatcctccaattcaatcaccagcgagggcgctaaccgcagaacatctggacccgcattgaggatcatcaagccgttagcggcagcggcggccaggaactcacgcgcctgcccccggtatttcgcggttaactccgcgccaatcaacaaccccataccacgaatatcactgaaaacatcatacttgctgttgatgctttgtagcgcctgcacaaacagaccatggcgctgttcaataccattaagtacctcaggggtattaatcacatccaacgcggcctcagcgaccgcacaggccagaggattacccccataggtggttccgtgggtacccaccgtcatcactgaagcgatctcttcggtcgttagcatcgcactgattgggaagccaccgcccaatgccttcgccgtggtaaggatatccggcgtcacaccatgatgcatatagctaaacaacttgccactgcgccccataccgctttgcacttcatcaaacaccagcagggcgttatgttgatcgcacaacgcgcgcaccccttgtaggaactctggcgtggcagaagtgatcccgccctctccctgaatcggttccagtaccacggcacaggtgtgatcatccatcaccgctttcactgccgccagatcattaaacgggacatggatgatatccgcaggtttcgggccaaaaccatcggaatactttggctgccccccgacagagaccgtaaacagggtgcggccatgaaacgcattgtggaaagcaataatcttggttttataggggctatgacgctcaatagcgtaatggcgagctaacttaaatgccgcttcattcgcttcagcacccgagttggcaaagaaaacccggtcagcaaaggttgcggcaatcagcttctgtgctaaacgcagtgctggctcattggtaaacacattactggtgtgccacaacgtttcaccctgctgatgcaatgcggataccagtgccggatggcaatggcccagtgcggtaaccgcaatgccaccggcgaaatcaatgtactccgtaccttgttgatcccacactcggctgcctttcccttttactgggataaactgcgcgggtgcataaacaggcaaaatgacctgatcgaatgtgttgcgattcactgctaacttatctgtcattacgctgcccaccctaataaaccactaagctgttatttattgacatgtgaaaatatactcacaaaatatgcataaaaaatcatccgcaagcaaatgataaatgatgtcatgggataatattggcccaaccgattaatttttaagaaaattatccagtaattgatggccctgttcactgagaatactttctggatggaattgcaccccttccagtggcaatgtgcgatggcgaatccccataatctcatccatctcaccgccccgctccgtccaggcagtcagctcaaaacagcccggtagggagtcggtggcaatgactaaagagtggtaacgggtcaccgtcaatggctgattaagcccacgaaaaaccccttgcccagaatggcaaatcgccgaagttttgccgtgcatcacctgacgcgcacgcaccacgcgcgcaccaaaagcctgccccagagcctgatgaccaaggcagacccccagaataggcagtttatcggcaaagtggcggataaccgccaatgagatcccagcctcgttaggggtacaagggccgggagagatcaccacatgtgagggggccagttgttcaatatccgtcagttgcaactcatcgttgcgcttaaccatcacctcagcgcccagctcacaaaaatactggtacaggttgtaagtaaatgaatcgtagttgtcgatcagcagtagcatcgttaatttatcccactgattattagagttataaatgatttaatagattcccaacacccactattcatttttatctataccccaattatctataccccaaatagtttgtcagcagtctgacaacccacacagttggttgaagtacggcgtggataatatctatgacttcttgattgatgttttttgagccaacgttaccgttctggaagcttgcgcggatattggctataccggcccccccgcttagcgtttgcgcccccccgtaattgaccccaaaacaccgcgcaaaatttgccggcctaaatcccgtgccatgctcttggccgcagtctgcacaataccgtcccgcttaccgcctcgcggccccgtggaaccaaacagtaaatcattcagcccgcccattaagccaccaccactaccctgctgattcgtcggttgctgaggaacagaaggctccccttcagcggcacgccccatggtagaaaagccccccgccgataacttttcataagcagactcgcggtcaatcatctcttcatagcgaccatacagtggggaatgattgattgcgtgattacgtgctactgcatccaacgcgcccatttttgattgcggtgcgataaccatcgcccgttcaaccacattaggccgccctttctcatcaaggaaagaaatcagcgcctcaccgacgcccaactcggtaatcacctgttcagcactgaatgccggattaggccgcatcgtctgagctgcggctttaaccgccttttgatcccgtggcgtaaaagcgcgtaacgcatgttgtacccggttacccagttggccgaggatcttatctgggatatccagaggattttgtgtcacgaagtagataccgacccctttcgagcggatcagccgcaccacttgttcaaccttatccactaacgccgccggggcatccgtaaataacaaatgggcctcgtcaaagaaaaagaccagttttggcttctccacatcacccacttccggtagctgttcaaaaagctcggccaacagccaaagcaggaaaatggcatataactttggctgattaatcagacggtcggcagccattaaattgataacgccctgcccgtggctatctgtttgcatgagatcgtgaatatccagcatcggctcgccaaaaaattgattggcaccctgctcttccaaggtgagtaaaccacgctggatcgcgccgatagaagcggaggtaatattgccatattgcgtacggaactgtttcgcattgtccccaacatactggacgatagcacgcaggtctttcatatccagcaacagcaggccgttgtcatcggcgattttaaataccagttgcaaaacaccactttgcacgtcatttaaatcgagtaagcggccaagtagaagcggcccaagatccgagattgtcgcccggataggatggcctttttcagcaaagatatcccaaggcacaatcggacacgcctgtggctgccaatccgtgacatcaatcgcggccagacgggcctgtagtttttccgaattcaccccttcagccccgataccggataagtcccctttcacatccgccaaaaatacgggtacaccaatacgagagaactgctcggccatcttttgcaaggtgacagttttacctgtaccggtcgcaccggtaattaagccatggcggtttgccaatgccgataagatcaccaaatcacgtgaagctggctgagttttctcggtaaccagcgctttcccaataagtaatgtgttactcatgatctttttactccatcgcggctgaggctgaggtagaaacagatagcttgattatatacccttcatacttgaagcggctgccgggttggctacgctaaatcacctcaggggttcggggcatgaaagcgggtaatggggccattaaggtcagactgctgcccccagaagactcgtactaaaacggtgaggataagcgaagagttgagcgtccgcgccaaagagggcgcggcttgagcctacatggatattatttttatgcggggaagacggcgtctttacaatctgcttcttccctccgctgcgagctctgtttcaacaaccccaattaaggtaaaacttttgctgacaggatagtgatcggtttaacgggtacattctgataagggccgacgttttctgtctgaacctgagaaattttttcgacgacatccatgcctttaacgactttaccgaataccgcataaccaaagtcacgttggccgtggtcaaggaaagcattgtctgccacgttcaagaagaactgactggtggcgctgtctttatctgcagtacgggccatcgaaatggtaccacgtaggttacgcaggccattatctgcttcatttttgattggtgttttaggcgttttttctttgaaatctgcggtaaaaccgccgccttgaatcataaagccagggataacacggtggaaaatagtgttgttatagtaaccattgttaacataatcaacgaaattctgggttgaaatgggtgccttctggctattgagctccagctcaatattcccggccgacgttgttaacaacacatgaggctcaccggcagctaaagcagcaggcgctacggcgctgagggaacatagggcaatgaaggtcactaaagtacgtttaaacattaacggttcctttctatgggatgcggacaacggaaaagcgctttgattctagagagctgacccacgcaatgccacccatttacggatatttacgtaacagaatgcacattttcactgaaaaaccgccacatcggtagataaagcgcacaatggcgattaatgaataaaatttaatgagtcaccacatcccagactccagcaagattctggagtctggatcacgattctcttactttccctcctcccggtagccatttttgcgagaaatatctcattttgtttttggttactcgctaatctgcttcaaatgagagcgctctcattttgttttctgcaagtatcaggcccgcaatgcaacaggaaactatccataagcggagaccgtacagagacaggctcacctgatgaaaatcatggtgagcctgaatttatccacagatatgttattcacaaacatgttatccacagacatgactgaactttatcgccggcagagccgtttggagcccctacaatgagcacgtttaaaataaccattattggcggtgggagtagctataccccagagctagttgatgggttgattcagcgtattgaacaattgcccgtcactgaactggcactggttgatgtcgagcagggccgccaaaaggtggaaattattgccgcgctgacccaaagaatgcttgcccgtcatgggttggaacaggtcaaagtcagtgtccactactcgctggatgaagccattcgcggtgcccgttttgtcctgacacaatttcgtgtcggccaactccctgccagggcagcagacgaacgcttggggttaaaatataacctgctcggtcaggagacgaccggaattggtggctttgccaaagcgctgcgtaccattccggtgatgcttgatattgctgctaacgttgagcgattggcccccgatgcctggatcattaacttcactaacccagccggcattgtcaccgaagccgttagccgctataccaaagcgaaaatcattggtctgtgtaatgtcccgatcagtatgcatcatatgattgccaagctcttgcaagccccctacgaagacctccaactgcgctttgccgggctgaatcatatggtatgggtacatgaagtattacaacgcgggaaagatgtcaccgctgatgtgctgaaaatgctgtgtgatggggcatcattaagcatgaacaatattaaggaagccccatggccacccgagttcctgcaagcaatgggggccatcccctgcccataccatcgctatttctaccaaacgcaagacatgctggcagaagagatggccgcagcagctgagcgtggtacccgtgcggaacaggtgatgcaggtggaaaaagagctgttcgcgctgtacgccgatccgcatttggataccaaaccagagcagctcagcttccggggtggatcattttattctgaagttgcattggaacttattcgtgccatccataacaacttagggacgcaattagtagtaaatacaacaaaccgtggcgcgattcgcggtttatctgatgattctgtggtagaaactaactgtattattgatgcaaaaggggctcatccattaaccttcggccctttaccggtctctatgcatgggctaacccaacaggtaaaagcctatgaacgattgacgattgacgcggcggtacatggcgatcgtcgcagtgccttgttggccttagtgacaaatccactgattgctaacgccagcattgctcaaccgttactggaggaggtactacaggtgaataaaccttacctgcctcagttctccggtttgtgatgacctagccaacgtcattggtgttgtagcactatcagttcggtttataacgacatcagcttgtttgtagcgatattggtttacttgtaacaatatcagtttacttgcaacaatatcagtttacttgtaacaacatcgctttgcagcaaggctgcgaataccgcagcagcgtcaaggacgaaaggtataaactaacgattatggcggccatatatagggtcgccgtttcaccttaacaggagcaaaagatggttacactggaagacgtcgcggtattagccggggtatcccgtgctacggtttcccgcgtggtcaacggtgataccaatgtaaaggcccttacacgtgaaaaggttgagcaggctgtcgccgttctcggttataccccgcaccctgccgcacgggcactggcatccagccaaagtaatacgctggggttggtgaccacctcataccgagggggcttttttggtgccttaatggattttgtgcaaacagaaacagaatcccaaggtaaacaactgttggtcactcagggacgagataatgcagataaagaatggttagccattcagcggctgtataacttacgctgcgatgggttaatcctgcatgtgcgctttctcagcgacgaaaggctgcgtcagttagctgcagcaaaccggccttttgtattattggataggttggttcctgatcttgaggctcgctgtgtgacctttgatcaccatcatgccagccaaatggcaacgcaggtgttgattgatgcgggccatcgcgacatcgcctgtatcagcggctcttcacaacgccaatccagtgttttacgcattcagggctttcttgatgccatgcagttggcgggcttagaacccgtggcttgtttggagggcgtttacgatctggaaagtggctacctgcgggctgacgaaatcctcaagcaaccccggctaccgacggctatctattgctgtaatgaagagatggccattggagcattactggcgataaataaacacggtttacaggtgccgcaagatatttcgctgatttgctatgacagtggcgagcgcgctccttttgtctgcccagccttgaccagcgtacactttccaatcgtggaaatggcgcaatatgctacacagttgctgattgacccgctgatccctgccgtcaatttcccacccgcgattatcatgcgtgattctgttatgccgccgaaaacagcgtgttaattggtgttggtattggtattaattgttattggtattaattgttattggtattaattgttattaacgtggcaagccatggcctgccacgttctgctagcgcattcagccccttagaatgttaggtttagctttgcccagagagtgcggccaggctcattcagaggggtattaactgaataaccaaaaccgctattacccgccagattaagatgttcgctgtaagccttattcagcaaattatcgatgccgctacttaacttcacttgcttattcaccttataggcgacgttagccgacagtacgccgaaccccgcactgctggaaaaatctttaccgacgacattcccttcgttgatcgccacccggtgctggctattgaccaaacgccataaggcggaactgctccagtcgcctgcttcaaatgtcagccctaaccgcgcctcaagtggtggaatttgcggcaatggccggttatcacgggtattttccccccaggcataagccagactggcatcagccttccaatacggggtgagggcatattccatccccatctcgccgcccataatggttgcgttaatattatcggcctggctgatgcgtagattttttggatcatatttaaacaggataaaatcattaacccggccaatataagcggagagccaccccctaaattgttcaccgctgtattggccaccgatatcaatctgcgtggttttttcgctttttacaccctcaaaggcgctagtagagcctgctggcccgaattttggcgaaaacagttcccaatagtcaggaaaacgctcggtatgccccaagccggcatacaacatcaccggtgcattagccagattatgctcaacacgcataaaggcagcggggagggtagcagagcgcgtcggctcacctgcgcgggtataattcgtcacttggtgacggtcaagacgcgccccgctgatcagtttattttgttcacttgccgcccaggttaactcaccgaacaccccgttattcataaaacgggcgtttttatcccagttcccctgtttattcttgcggtgtgtattggtttgcatatcggtacccgcgtccagctttaggtcctgccacagccaggtccccatgacccgaccgccgagcatccgccggtccagattgctagacatcgccatcatcggtggggtacgtaaggtcttgttatccataatatgatttacgtaggtgtagttaattttggcttcgatcttatccagcacctcgccaatattacttttctcaacgcgggccgccaggctctcacgcaggaactgagaaccatccataccgcgaccgccatagcgggattcaccattcccttttcctaccgacagctcaagtaatgtatcggtatcgggtgtccagcccaacgccatatcggcattccacttatcccattgagagggcacgcggacattgttaccgtctttataatcagcagctcgagactgattccccatcatccgcagatagccctgctcattacccaaactggcatcaagatttttatcccagcgcccattagaaccggctaacacactggcattacctttgacgccagactggtcaaaatgtgggcgctcccgttcaaataaaatggtcccggcagaagcccccggcccccacagcaccgattgcggccctttgacgaccgtgagtagatcaaaattttctggtgaaatatacgaggttggcgcatccattcgcgatgggcaggtacccaaaatctcagcaccatcggtcagaatttttagccgtgagccgaacatgccacggaacaccacatcaccattggtccccccgttacggacgagtgaaaaaccgggaatggtcctcagataatcagcaccgtcactggccggtactggctggcggggcactttaggcgatgtggcaaccaccagtggcgaatacagaggggctgttaccgtgatgacatcagcgtcattgagttttttattactgttatgcgtgcttgatatattaatggctgagcgattcattgcagccagactcgtagtatcggcaatggcatttgaagcaaaggcagaaatagccgaagtaaccgcacacgctaataacttctttttacagactttatttttcccagatatcattacttccccttaggcaatacacattgttccggcgggatatttacccatgccagaaaagtggttttatattttttcgctttctatcaggaataattggatcgaaaaatcgcgcttatcgtagcggagccaacatcaacgtaacctcaaatttaaggcaattaagaattcttatcgtttagctcgcgaaacaacctcttacaagtcacggttaatagccatttcatttcattaattgcaccaaaaactgaatgtatctcacaaaaaatcattatgtctgtgctaggatccgctgccttagcgctaaaacggggtttaacacctttttagtcctatatccgttttagcaataatcatttttaaactagatacccgaaggtattggcgttgcaataaagcagcaaacacgtgccgttaaccatcctgtggtgacaagaatgctgtagcgccaaagaggaagggtaaatactgacatacaggccacacctatgaacaacagcaatcgcattcggctcacttggatcagttacttgtcttacgcccttactggcgcgttagttattgtcaccgggattgtgatggggaatatcgcagagtatttcaatctgcctattgccagtatgagtaacacatttacttttcttaacgcgggtattttaatttctattttcctcaatgcttggttgatggaaatcattccgttaaaacgccagttggtctttggtttcattttgatgttgatcgctattgccggattgatggtcggccataatttaatgatcttctcaatcagcatgtttattttcggggtggtcagcgggattaccatgtcgataggcaccttcttggtcacccatatgtacgagggtcgccagcgcggttcacgactgctgtttaccgactcctttttcagtatggcggggatgattttcccaatcgcggcagccatgctgctggcgcgtcacattgaatggtattgggtctacgcctgcatcggcctattgtatgtcgggattttcgtgctgactctgtgctctgagttcccggttcttggtcataaagccacagaccaaagcaagccagtggtgaaagagaaatggggagtcggtgtgttgtttctggcgattgctgccctatgttatatcctcggccaactcggttttatccagtgggtccccgaatatgcaaccaaaaccttcaatatgaatattagccaggcaggccaattggtcagtaacttctggatttcatacatgatagggatgtggatattcagctttatcctgcgcttctttgacctgcaacgtatcgtaaccgtgctggcggccatggcaacactggcgatgtatctgtttgtcagcaccgataaccctgcatacttgagttactacattttggcgttaggttttgtttccagtgccatttataccacgctgattacactcggttcgctgcaaaccaaagtgtcttcacccaagctggtgaacttcattctgacctgcggtaccgtagggaccatgctgacctttgtggtgacgggtccaatcgtcgccaacaacggtgtacatgccgcactggcaacggcaaacggtttgtatttggcggtatttatcctgtgtctggcattaggtttcttcaccaaacaccgtagccacggccacgtgacccactgatttatctgcgttactgccctgccgccgccaaggtggcagggtattgatgattcactaatgccgtaaacatcgaaaatcctaccgttaacgccgaaaatccacgatctcttcctgccccagatatatccggctctctgcgggttgcgtcttcgcgatcaccacaccatgacgaatagagtaactgacgggaacctgccgccgtagagcatcaaaaccattttctgcgggtagaataatcaggttggcgcggttaccaggctgcaaaccataatctgctaaattcagcgtcttggcactgtgggtggttatcagattcagaccatcattaatttgttcatatcccatcaactgacaaatatgtaatcccatatgcagcacctgcaacatattggcggtacctagcggataccacgggtcgaacacatcgtcatggccgaagcacacattaatctcggcagccaacatctctttgacccgcgtgataccacgccgcttcggataagtatcaaaacggccttgcagatgaatattcaccagcgggttggcgacaaaattaatgcccgataatttcagcaagcggaacagccgtgatgtataggcaccattataagagtgcatcgccgtggtatggctggcggttacccgtgcgcccatattttcgcgaagggccagcgccgccacggtttcgataaagcgcgattgctcatcatccgtttcatcgcaatgaacatccaccagccgctgatatttttgcgccaatgcaaacgcgatatgcaaagattccacgccatattcgcgggtaaattcaaaatgggggatcgcccccaccgcatccgcacccaagcgcagtgcctcttccaataacgccgcaccatcaggataagagaggatgccctcttgtgggaaagccacaatctgcatatcaacccaagggctaacctcttctttcacctccaacatggcgctcaatgccgtcaagtgtggatcggaaacatcaacatgcgttcggacatgctggataccgttggctatctgccatttcaatgtttgccaggcccgctgcttcacatcctcgcgcgttagtcgcgctttgcgctccgcccaacgttcaattccctcaaacagagttcccgactgattccaactcggttgcccagcggtttgagtcgtatccagatgaatatgcggctcaataaatggcgggagcgccaaaccgccctgcgcatccagcacaccttgccctgttaggggttgctccggctgaggctgaatcaggctgattttgccttccgctatcgttatctgccacagccccgctaaccctatacgacgcacattatttaccgtcgttaatgaataattcggtacagattgccctgccatcaatgcctccactctctctttcctcctctcgtcatcacgaaaagcggttttctttagcttacctgagccaccctcgcctgcccgattttcttttactcataatcattttctccttactcataataattttcttttatttgtaaaaatcccaaagctgatacctttcagctaaagatgaacaaaatcctcaacttatcaaaaaagcttaaaaatcatctatctaccaccttagaggtatatgagaagcaaattgatttacatcaagaaacgcgtctggcggaaggctaaggtgagtgtagaaaattaaaaattgagataaaaatgagcaaaataaaaattgccatcattggcaacggcatggtcggccaccgctttatcgaagacttattggataaagcggataaggaccaatttgatataaccgtattttgcgaagaaccccgcattgcttacgatcgtgtgcatctttcctcttacttctctcatcataccgcagaagaactgtcactggttcgcgaaggcttttatgaaaaacagggcgtgaaggtgctggtgggtgaacgcgccatcacgatcaaccgtgctgaaaaagtgattcactccaacagtggccgaagcctgtattacgacaagttggtgatggcaacgggttcttatccgtggatcccacctattaaaggtagcgaagggcaagattgctttgtttaccgcaccattgaagacctgaatgccattgaggcctgtacccgtcgcagcaaacgtggtgccgtcattggcggtggcctattagggctggaagccgcaggggcattaaagagcctcggcgttgaaacccatgtgattgaatttgctcccgtcctaatggctgaacagcttgatccgatgggcggtgaccaactgcgtcagaaaattgaacgcatgggggtcagagttcataccggtaagaatacccaagaaattgtacattccggccaaaatagccgcaaaaccatgttgtttgctgatgggacgcagttggaagttgattttatcgtcttctccaccggtatccgtccgcaggataaactggcgaatcaatgtggtttagccactgcccgccgtggtggtattgctatcaatgattattgccagacatccgatcctgatgtctacgccattggcgagtgtgcgtcatggcaggaacgaactttcgggctggtcgcgccgggttataaaatggcgcaggttgccgcagaccatctgttaggccgtgagaatgctttcctcggtgctgatatgagcgccaaactgaagctgctgggcgtggatgttggcgggattggtgatgcccatggccgtactgaaggtgcacgcagctacgtttatctggatgaaagcaaagaaatttacaagcgtttggtggtcagtgccgataacaaaaccctattgggtgccgtactggttggcgataccaccgattacggtaatctgctgcaactggcgttgaataacatcacattaccggaaaacccagacagcctgatcctgcccgcccatgcaggtaataaacccgccatcggggtggattccctgccagatagcgcccagatttgctcctgctttgatgtgaccaaaggcgacattattcgggcgattggacagggctgccagactgtcgccgcgctaaaatccgcgaccaaagccgggaccggttgtggcggctgtattccgctggtcacccaagtattgaatgccgaattaagtaagcaaggcattgaagttaataatcatttatgtgaacacttcgcctattcacgccaagaactgtatcacttgatccgcgttgaagggattaagacgtttaccgaattacgggaaaaatacggcaagggctacggttgtgaagtctgtaaaccgacggtcggttcactgctggcgtcgtgctggaatgagtatgtgctggagccacagcatacgccgttgcaggataccaatgataacttcctcggtaatattcagaaagatggcacctactcgattattcctcgttcaccaggcggtgaaatcacaccggatggcctgctcgtcgttggtcagatcgccaaagaatataacctgtataccaaactgaccggttcccaacggatagggatgtttggcgcacaaaaagatgacctaccggctatctgggcacggttgattgacgcgggctttgaaacgggtcatgcctacgccaaagcactgcgtatggcaaaaacctgtgttggcagtacctggtgccgcttcggtgtcggggatagcgttggctttggtgtggccttggaacatcgctacaaaggtatccgcgcaccgcacaaaataaaatttggcatctctggttgtacccgtgaatgcgcagaagctcagggcaaagacgtggggatcatcgccactgaaaatggctggaatctgtatgtctgcggcaacggcggcatgaaaccgcgtcacgcggatttactggcagccgatttggatgaagagacgctaatgcgctatctcgaccgctttatgatgttctacatccgcaccgccgataaactacagcgcacctccgtctggctggaaagtttggaaggggggattcgctacctacaatcggtgatccttgaggacaaactgggcattaacgatcaactggaagcagagatcgcccgtctgcgcgacaaggtcgcctgcgagtggaaagccactgtcgagaacccagcagcacaagtgcgttttgcccactttattaatagctcactgcgtgacccgaatgtacaagtcgtgcgcgaacgagagcaacaccgcccggcccgcccagatgaacgcatcccggtcagggttttggaactggaggataacgcatgagccagtggatcccactatgcccgttaaatgacatcttacccggcagcggtgtttgtggcctgattaagcaacagcaggtcgcggtcttccgcccttatgctgacgaacaggtttttgccattagcaatatcgatccttttgcacaagccagtgtgctatcgcggggattaattgcagaacatcaaggtgagttatgggtcgccagcccactgaaaaagcagcacttccgtctgcgtgatggcttttgtttggaagatgaagatcgctccgtgacccattatgacgtgcgagtgcgcgacggtatggtgcaagtcaacgcgtaacacagacaaaacgtaagcagcatagatagcggatcaatccagctaacgctgggttctcaacaaattacttttaatcatcccctacgtcgtgggtattgtcgttgatattgtcgcaaggcagtaaacaccgctgcggcaccaagaacgaagggggtttgggaaaaaaatgtacactgacaccatcaataaatgcgcggccaatgcggcccgaatcgtcaagctggccaaagagagcccactaggtttttggattggttccgccatggcgggtgcctatgtgggcttgggtatcatcctgattttcaccttgggtaacctcatcgaccccgcccttcgcccattggtgatgggggccacctttggtctggctctaacattagtcatcattgccggttctgaattatttaccggtcacaccatgttcctgaccttcggtgtgaaagcaggcaccatcaaatccagccaaatgtgggcagtattaccgcaaacctggttgggaaatctactggggtcggttttcgttgccctgctctattactacggtggcggcaacctgctctccgtggacaccagcctggtacacaccgcggcactggcaaaaaccacagcaccggcgatgaccttattctttaaaggcgtcttatgtaactggctggtttgtctggcgatctggatggcgatccgcgttgaaggcgcggcgaaatttatcgctatctggtggtgtttgctggcctttattgcctcgggttacgaacactccgtagcgaacatgaccttgcttgcgttgtcttggtttggccatcacagcgaggcatacaccttaagcggcatcggccataacctgttatgggtcacgctgggtaataccctgtcaggcgcggtctttatgggcctgggttattggtatgccacccctcgggcgcaacggccacaaccggcaacgattaacgccccacacagcgcaaaatcataataatttggcagcgctgtgataactcgttgccctgcaacagactgaaaactgaaggattgccgatggactacttcccgatcttctgccaactgcaacacaaagcctgcctgctggttggcggtggagaaattgctgaacgcaaagcgcggctgttattggatgcaggtgcgttagtcaccgtcaatgcctgcgagttcaccccccagtttcaccattgggcagatcaggggcaactttcattaatcagcggtgaatttgtgcccgaactgttggccgataaatggctggtcattgccgccaccgatcagttgtccgtcaatgcattagtctatcaaagcgccaaccagcaacggatcttctgcaatgtggttgatgatccgaaacgcaccagctttatcatgccatctattattgatcgctcccccatcatgatcgcggtctcctctggcggtaaagcgcccgtgttggcccggttgttgcgcgaaaagctggaagccctgttaccgcaacatttggggcaactggcgcaactggcggggaacttacgccagcgggtgaagcagcattttgccgcgatgaccgaacgtcgccggttctgggaaaagttgctgacccacgaccgtctggcacaatctttagccaataacgatcacgtgcaagccgatcaacatgttgaacaactgtttagtgctccactcactgatcgtggcgaagtggtgttggtcggtgcagggccgggagatgctggtttattgaccttaaaagggttgcagcagatccaacaggccgatgtggtggtctatgaccggctggtctccgatgaggtgatgaatttggtccggcgtgatgccgagcgcatctttgtcggcaaacaatcgggccaccactgtgtgccgcaagagcaaatcaaccaaatcctgttacagcaggcacagtcaggtaagcgggtagtgcgtttgaaaggtggcgacccgtttatttttggtcggggcggcgaagagttagaagagttggcgggctacggtattcctttctccgtggtcccaggcattaccgccgcatccggttgctcggcttacagtggtattccactgactcaccgtgaccatgcgcaaagcgtgcgactggtcaccggtcatgccaaaaaagagggccagttagattgggcaaatctggcggcagagaaacaaacattagttttttatatggggctatcgcaggctggagagatccaacagcaattgattcaacatggtatgccagcgaccactcaggttgccttagtcgaaaacggcacctcacggcatcagcgggttgtgagtggcgagttaagccaattggccttactctcccaacaggtcagtagccctagcctgattatcgtcggtagcgtggtcagcctacgggaaaaactgaattggttttccagccgccatcacgatgatcagcccaaagtgactgaatgtgtggctcatgttggttaaggttagcggtgtagttaaggttagctatgcagttaaggttagctatgcagttaaggctggctgtgtgagtaatatgggttaatgctgattaatgagggggaaatttccccctcacattactgatgcgttgtgatcgttacggctgcgcgacaaaaccgatggcttcgtacactttagccaaggttacttgtgcgcgggcacgggccttggcggcaccttcacgcatcacatcttgcaacaacgcctcatcttcacgataagtacgataacgctcttgtagctcgctcaacatgccagaaacggcatctgccaccgctcctttcaaatgaccgtacatctggccagtaaactgcgcttccagctctgggatcgattgaccggtcacaccagacagaatatccagcaaattagacacgccggcttttttctctacatcataacgaatgagcgcaggttcatcagagtctgtcatggcacgcttaatctttttaaccaccgatttaggatcttccagtaactcgatcacattgttacggttgtcatccgatttagacattttcttggtcggatcctgtaaagacatgacgcgggcgccagctttaggaataaacggctcagggattttaaaaatatcgccatacagattattgaaacgactcgcaatatcgcggctcagctccaaatgctgcttttggtcttcccccaccggtacctggttggtttgatacagtaaaatatctgccgccatcaacaccgggtaatcgaacaagcccgcattgatgttttctgcatagcgcgccgacttgtctttgaactgggtcatgcggctcagttcaccaaagtaggtatagcagttcaacgcccagctcaattgagagtgttcaggtacatgggattgaacaaaaatggtgctcttcttcggatcaataccgcaggccagatacagcgccagcgtatctaatgttctttttctcaacagtgccggatcttggcgagccgtaattgcatgcaggtcaacaatgcaatagatgcaatcataatcatcctgcatctgtacccactgacgaagcgcacccatgtaattaccaatggtcaattcgccggacggctgtgcgccgctgaatacgataggtttactggatacagtgggtttgcttaataccatgggttcactcattttatacttcctgatcttttaaagatggtagcccaatggcgggcaacaggtcggcaaaatgcgccagcacgcagtctggatgactggtggcaatcgcttcaccgtagttatatccataggtcagcccaatacaagggcaacccgccgcctgtgcggccataatgtcattacgcgagtcaccgacaaacagcatttcacgggcatgtaagccaagttttcccagcaataaatacaacggggccggatgcggtttcttcaccaccacatcatcgcccccaatgatgactgagaaatagtccgcgatccccaatgacgttagtaaaggggcaacaaacggtgttggcttattggtaatgaggcctattggcaaaccattggcagccaattgagctaaagtggctttcacttgcgggaataactggctcccctgctcaacggttttggcataatagtgatcaaacagctcgcgggtctgtgccacaagctgagcattatgttcacgccctgcccaatgcaacgcgcgctcgactaagacatctgcgccattaccaatccaagtggagactaacgcttcaccagcggcaggcaacccctgatgcgccaacgccatatcaattgcacgggccagaccaggcgcgctgtcgactaatgtgccatccagatcgaatgcaacaccacgaatcgctttaaacttaaccattagccgccatcgccagttcattgcgcatggcatcgatcaccgcagcataatcgggttgattgaaaatcgcggagccagcaacaaacatatcggcacctgctgcggctatttggcgaatattctcgaccttaacaccgccgtccacttccaaacggatgtcataaccgctgtcatcaatcaacttacgcacctgacgcagcttattcagggtttcaggaataaacgattgaccaccgaaaccggggttaactgacatcagcaaaatgacatccagcttatccatcacatagtcaagatagctcaggggagtcgctgggttgaacaccagaccggccttacaaccactctctttgatcaattgcagcgtgcggtcaacgtgttcagaagcttcgggatggaatgtaatataggttgcaccggctttggcgaaatccgggacgatacggtcaaccggtttaaccatcagatgcacatcaataggtgcggtgatcccgtaatcacgcagagccttgcacaccatcggcccgatggtcaggttaggaacatagtggttgtccatcacgtcaaaatgcacaatatcagcacctgcggcgagtaccttcgcggtatcttcacccagccgggcaaaatcagctgacagaatagagggggcaattaaatactttttcatccgtttctccaaacatgttgcttcgtcttatgaaagatcggctttatcaacctggacaccgggctataccccaaataattcgagttgcaggaaggcggcaattgagtaagcccccaccagtaagtgactggggtgaacgaacgaaagcaaccaacactcatgcagcttgaaatatgacgggcatatcattcaataacatttaataaacaaccactaataaacaaccaccacgaccatttgataaactatcgccatcacttcataaactccccgtctgagcgattaccggacagcaatttcactcagctatagagcgccaaaagttcgtttaccttactgcgaccaaggatattacggctgatcgtacggcgcgcagtgacgacatgtagcgacgccgcctgatgataccaattacgcgtcagttcggtgtcatggttagaaatcagtaccggtactttactctcagtagacaactgataagccagacgcgccagattttgctggtctgcaatcccaaagttattggtgtgataggccgtaaagtttgccgtcgctgatagcggcgcataaggaggatcgcagtaaactaccgctccctgcacggcttttaacaaagtttcctgatagtgctcacaaacaaaaaccgcattttgcgatttttcagcaaaccaatataactccgcttctgggaagtagggctttttgtagcgaccaaaaggcacattgaattcaccactcaaattataacgacacaggccgttataacagtggcgattgagatagaggaacagcaatgcacggcgataagcatccgtactggcattaaattcttgccgcagttggtaaaacagctcggaatgattgaagtcgccagtaaagagaactcgagcatcacgcacaaaatcatctgtacgtaacttaacgatattgtataagttgatgagatcgttgttgatatcagccagtatgtaagattcgaactcggtgttgagaaacacggaacccgcaccaacgaatggctctatcaaacaatctcccgctggaagatggcgtcgtatgtcatcaaccagcggatatttcccaccagcccattttaaaaaagcgcggtttttcttcatgccgtcagttagctacttaataattcagagccgcagattgtactctgtttcaaacagcacatcagcgcacaaatcagaatggtttattttttaaggtcttgctgtacttgttgtacaggcttaacccatggctttttcgcttgaacatcagcgggtaatgttgtgattgccttttttgcctccgcagaggaggcataattaccactcactagaatgtaccaaggcttaccatcacgtttggtttcgtacacatgatagtcagttaaattttgctgctttgcgtaggcattcagggtgtctgagcgcgatgcgctgcttaattgcagcgtgtagtggctactcggcgcactgctcaatgcacgactactggctgcgcctgatttaggcgtacccgatgtagcaggaggaacggccacagttgcggtatttttatggttaaccgccggttgcttagtggcctgtttctgtaccggttgcgtaatcgtttcacgcgtagcaggtacttttgcccctttcgatggagcaacagttgctgccgccgttggtagtgttgatgtatgagcgtcactgatattctgagataacgtatccacctgcccttgggtctgagagagggcatcggacatattaccaggcaattcaatccgctgagtcgtgctgttagccgaaggcggtattgcagcctcggttggcgttggcgaaattggcggagcactgatatcttgcggtggagccgtattctttacaccactggcatcatgaccatagctggtattgttcgcaatactgggctggttattattaccgctggttaacgaagacgaatcagataagttgatatctcgcgccgcattaacatttgggttttgttgggacgcttcatgttcggtaggtgctttcaaggcagaaccgatagcgataatgatcaatagcaacactaaaatgccaataccaatcatcatatgttggcgtgaaacagcaagtttaggcccggttggggacttgcgagagcgtgtaggacgacgatcactgctatctggtttcagatcgtcatccagctttaaatcatccatttaaaccctccaactagaggcaaaagcccgccgcatcaattattgcgatccggctgattgatttgaccgacggcaaacagcttaatactgtctgcacaaaagatacgatgttttacaatacaacatcataatacttatgaatatcgtacttatgagcatagcacttgtgaacagggttctgatgaaaagaacactgatgagcatagtttttatgaaacataattcttatgaaatatcacatctatgccattttctatggtcgacaatccgctatcgatgccaacaccatatcatgcgcaacaccgccccggatttctgatttaccgatggccgttggcagtaccagacgaagttcacccgccaatacttttttatcccgcatcatgtgtggcagataagattctggtgccatttctttaggcccacaaacgggtagaccagcacgtaataggagtttcttgatacgctcaacatcactgacagagagttgccccagacgacgggatgtctgtgcggccatcaccatcccagcagcaaccgcttcaccgtgtaaccacactccgtagcccatttcagcttcgatagcatgaccataggtgtgacccaaattgagtaaagcgcgcgcaccgctctcttcgcgttcatcagcagcaacgacatcggcctttaattcgcaacagcggcggatacagtaagctaatgctgacatatccagcgctaataaagcgtcaatgttgttttctaaccaatcgaagaaagctgcatcaaggatgatgccgtatttgatcacttcagccaagccagaagcgagttcacgcggggggagagttttaagacaattaagatcaaccaccaccgatgcaggctggtagaaggcaccaatcatatttttacccaagggatggttaacggcggttttaccaccaacagaagaatccacttgagaaagtaaagtagtaggaacttgaataaagcgcacaccgcgttgatagcaagctgcggcaaaaccggtcaggtcgcccactacgccgccacctaaggcaaccaacgtagtatcacgaccgtgcggtttttccagaagggcagaaaaaacctgctccataacgctcagagatttatactgctcaccatcaggtaaaatcacctgatcaactttaatgccaccgtgttccaacactgcccggagagaatccagatagagcggagccaacgtttggttagtgaccagcataacctggtcacccgcctttagcggcttaaaagaggccggatcattaaacaacccggcggcaatcgtaatggggtagctacgttcccctaacgtgacagtaatcttctccatgtcgcgctctgtaaccttcttaacttacgcccgtaggcattagtaaaatgctaaaatcagttactttccagcatgttgataatctggttagcaaccactttcgcgctttgatcgtcagtgcggatagtgacatctgcaatttcttcgtacaacggattacgttcttttgccagtgcttctaacacttcacgtggaggttcatcgacctgtagcaacggacgttttttgtcacgctgtgtacgggctaactgcttctcgatagtggtttctaaatacaccacaaccccacgggctgacaaacggttacgggtttctctggatttaacagagcccccaccggttgccagaacaatgccttgcttttccgtcagttcattaatcactttttcttcacgatcgcggaaaccttcttcgccttccacgtcgaatacccagcccacgtcagctccggtacgtcgctcaatttcttgatcagagtcgaaaaactccatattgagttgctgagctaactgacgaccaatagtgcttttgccggcacccataggcccaaccagaaagatattgcgtttctctgccatgtttttggtattactaagactattcgttaatgataacccgccccgccaatcaaattagcggcgggacctaaactgaaacctcatgagcgatagtgcgagatcagacggaaaattatctcagcacatctggtagtttggcaaccgaataaatcgttgtacacgtcgtgggagggaaaccatacgtttttatcggcgtatcaacgttaattaaaaacctcggagctcaattcggtaacccttgtatgctaaatctgtcgcagcgtcaaatttagaagcctccaatcacacaaaaagttgcagaaagtcaccaagactgccctgttttcataaaatgacatcttacaaggctcaggcactgattaattttggcgtaatgaaaatcactaactcccgccgactttgctgttgagtatcttgcctgaacatcgcgcctaatagtggaatatcggccagtaacgggactttattaacactctggcgttttttttgttggaaaatcccgcccagcacgatggtttcgccatcgtttacagtaacttgtgttttaatttcttgtttatctattagcaacatttcactctcaccgcgtttaatagtgataccgggcatattttgactaatttttaggtctaggatgattttgccattacgtagaattttgggtgtgacctccatccccaacaccgcttctttgaactcaatggccgctgcctcttttttaccccgtgagacagtataaggaatatcagaaccttgtttaatactggcggtttgttgatgtgaggtaattaagcgtgggctggcaataatatcgacctggttctcttgctccaacgcactcaactcaagctccagcaggcggccaccaatacgggccacatgaaaccccacgctcgcggcgctatttggcaacggcaaattgacattaaaatcattgattctgagcgcggtgtttcccttgccctcccccatcccccagcgcacacccagctcttgtaaatcttcactgctgatggtcacaatatgcgcggataactgtacttgttgtaacggtaaatccatctcaatcagccagttttttaacaatgccagtgaagcgggcgtatcgcgaatcaataatgtgttcgtccgcttatcggccaccacactgcccaatggagaaagcagcccaccttgcagcggatccaaactgtcagccacctgttcagcattcgcgtattgcaatgccaatgtcaggttagccagtgcttctggcgcagcttgctgtttcgtccgctgctgcctttcttgaatttcctgttcggtaaagaccatcatcacggtcccctcgcgctcagctttcaaacgccccatccgcagaatgatcgccaatgcctgctcccaaggcacttcaatcaaccgcaaactgagattgccgcccacaccggtagtcgtgatcagattaagttgccgatagtcagccagagcctgcaagatgacggagaccggcgcatcctgaaattccagggtgactggccccccgctgcgggtacgcggtaatgaggcattactggatgaggcattatttggtgagatattacttgatgcgacattatttgataagacactgtttgataagacactgtttgatgaagtgctatttgatgaagcactgtttgataacttgctgtctgataaatggctattggaggagcggctgtgtgatggcacgcccatgagtaagagacacccaattaataagccaatcaaccctctagagcgatttaagtgtttatttttgccaagaaaatacaccaaattgaagttcgtcagattgcaccaccaagtgctaaactgcttacctgcagcgagtataaaaatagtcatcagtttacttccttttaatgctgatcatcatccgacaatccattgaattcattgttgaaacagtgagaacgttaccgataatccagaacaaggcgtctcagggttttcatactgaaaatcgacccactgggcgcttatctgcgttacctgccattcggagactaaccgcatccctaaggttaacctttgccatgtggcatcagggcgttgtatccaggccgattgatagccaccaccactgacaaccccgtgtaatttccaccctgtaagcctttccctttcactatcacaggatgtcgccaagacagcttgaaaagggtcacgctcgatattggctagatggggtgatgcaaaaatgctggatggcagtaacccgataacgagtaaacgggtagcggctaaacccatagccaacaccgctatgtagctatttatcttgtagctatttatcttgaacatcaaaatcacccaagtcatccgtgagatactcggtgagtatcaacttcacggtaagcgcattgccatcaccgataagggaaataaccttaacaagaacaggtgatctgatttctgacagttgcccgaacagatggtacaaaccataaaaactcacccgcaatgtggcctcccaccgccggaaggcaatggcattttctaccacggcctcttccgaccctgagtagcgctgccagcggatcacttgcccgccaaaaggcataattgtttcaccgacctgatgggccagtaatatttcaggcttttgccaccacgcgttctctgacaacaaggtgtttatctgttggcggatcagtgcttgcgaaggtaactgcgccaacgctgacacctgctgctcaacgtgctgttgcaacttagtcacctcagctatggcctctgagcgctgttgccacgttggacgcagtaacccaccgtaagcgataaccccgagcaggcttaaaaaaaaccactgccataaacaaagctgccaacctggcctatccatacaacgctgtaatgatttattcatagtcccctgccacatgatgaccgtcgatatcatggccttctgcatgatggccttctacatgatggttttcgtcccgccaagaggcatgcaccacgaaacgaaaaccgccctcatcctgttgagtaatcccctgcaagctcacattaaccaaaagaggctgacggcctaacatcgctaaaaatgcattaattgtggcgtaatcccggctaataacctcgaaagacagcacatcaccttgctgccttagggccatcagccagcaacgttcagggatctgctgtgatagctgttgcaataatatggagtaacctcgggcaggttgatgagcctgatggtagcgctgaatatgctgttttatccgctgcaactgcgccattgcctgctgcacttgctgttgacgttggcttaatgcagcctgctgctgtgataatgccgccgccgtgccttgccggtgtttgtgttcactgcgggcctgcattagcaccaccaccagatagagagccaagccaataccttggatcagcatggtattgcgccagaaccggtagcgagcctgttgccggacaagacgccacggcaagaaattcacctgatacatcagtagcccgcacccgcagcagataaagagtctgccgcacgtaccgccagccccccggccaaagtaaaagctgccggtaacgcgggtaatgggggttgatagtgcgcaaaagccgttagcggtgaccaagatcgtgtgttttccggcaacgactcctttactacactgctgtaatacaccgccaaaggcgcgccatcttcaccagcacagcgcatgttgagctgagccaatagggccgacagcaagcgaatatcattttcctgcgttctgcactctgtctcgatagccaccaccccggaatgaaatggcatgtcactggacgatacccacagccattcatttgccaaccggtgaaccagccaatatggcccagataaaccggccgcggttgccatataacgtaaagcgcatggcgcaatatcaatcacttgtgaggataaacccgcctgttccaagcaggcttgccattgctgcacctctgactgacgcgctgcggttatcaataattcgctactcgcaaccgtttcgcggcagtaatccagtgccaaagcctggctgttaaccggaaatagtctgctggcactggctttaataaaaccatcacgttcgggttcacgcagacgcctatccggcacatgaatggtgtgctgcaatatgcgctgtgcgggcaaagcaatacgtaatgaaatatgtcgaggcagctgtttacgtaataatttgagttgttcgctaagaatatcaggctgatgtaatatgccttcccgcaaaacgccagaaggtaagacttgatgccaccagtagcgcagttgccagccattacggcgtcgtatcacggccaacgctcggatggcctccatttgaatatctagccctacctgccaatattgtgagtacatctttatcgacctccatgtcgagacagaataaaagaacgtatccatggtgcgggcttgcctttatactacgtcgcggttgtttataaactgcccaattgacattgaatgggaaatctcaggtgaagttcgtaaagtattttttaatccttgcggtgtgttgcattttactgggagcagcctcgatatttggcctgtacaaatatattgagccgcagctacccgatgttgccacgctgaaagacatccggctgcaaacacctatgcaggtgtatagcgccgaaggcgaattgatcgctcaattcggcgaaaaacgtcgtatcccattgacgttgaatcaaataccaccagaaatggtgcatgcgtttatcgccacagaagacagccgtttttacgatcatcacggtgtcgaccctgtggggatcctacgtgcagtctctatcgccatgttgtctggtcgcgcctcccaaggggcgagtaccattacccagcaattggcgaggaacttctttttaagccctgaacggactttgatgcgaaaaatcaaggaagcatttctggctatccgcatcgaacagatgctgaccaaagatgaaatccttgagctgtatctgaacaaaatttatctcggttaccgcgcctatggtgtcggtgctgcggcccaagtctatttcggcaaagaagtccatgaattgaccctcagccaaatagcgatgatcgccgggttacctaaagcgccttctacgtttaacccgctctactcatatgacagagccgtggcacggcgtaatgtggtgctgctacgtatgctggatgaaaaatacatcactcaggcgcaatacgatcaagcccgcagtgaagagttggtggctaactaccatgtaccgcaaatcgccttttcagcgccctatctggctgaaatggtgcgtcaggagatgattaaacgttacggtgaaaatgcgtataccgacggttatcaggtctataccacgatcaccagaaagctacagttggcggcagttgattcattacgcgccaacgtgctggcttatgatatgcgccatggctatcgcggcccgtccaatgtgttatggaaggtgggcgaaagtgcctggagccgtgaacagattatcgattcactgaaagcattgccggtgtatggcccgctgttacctgcagtagtcaccgaggcggatgccgcacaagctacggcaatgctggctgatggcagcaacgtgaccttgccgatggtcggtatacggtgggcgcgtccgtttaaatcggataacgcccaaggtccggtccccaaaaaagcgactgatgtcgttcagcctggtcagcaaatttgggtcagaaaggtcgatgataactggtggctggctcaagtgccggacgtcaattctgcgctggtgtctatcgatcccaataacggtgcaattaaagcgctagtaggcggttttgattttaaccaaagcaaatttaaccgggcaacgcaggcactgcgtcaggttggctcgaatattaagccattcctgtataccgccgcgatggacaaaggcctgacgctggccactatcctcaatgacctgccaatcacccgttgggattctggcgcaggcaccgactggcggccaaaaaactcacctcccacttacgatggccctatccgtttgcgtcagggtttaggccaatcgaaaaacgtggtcatggtgcgggcaatgcgggccatgggggtggattacgcggctgagtatttgcagcgctttggtttccctgcgcagaatatcgtgcattcagaatcactggctctgggttctgcctcctttacaccattacagctagtccgtggctatgccgtgctagcaaatggcggttacctggttgatccgtacttcatcactaaaatcactgatgatgtcggtaatgttctgtttgaaacaaagccgaaggttgtctgtgataactgtaacttgccggtcatttacggtgatacccaacgttcagttgtactttctgacgacaatattgagaacgttgcaacctcgcagaaccagaatgccagtaacgtgccaatgccagagctggaacaggtgacaccggcacaaacgacgctaaatagcgaacagcaatatgcgccacacgtgataagcaccccgctggcgttcttgatgcgtgatgcattgaattctaatattttcggggaacctggctggatgggtacgggctggcgtgcgggtcgtgacctgaaacgtaaggatatcggcggtaaaacgggtacgacaaacagctcgaaggatgcctggttctccggctacggcccagataccgtgacatccgtctggattggctttgatgaccatcgccgtaatttgggccgcagcacggcatcaggggcgataccagaccaaatttccggagcagaaggcggggcgaagacggcccagccagcatggaatgactttatgaaggtggcgcttgagggcttgccagagaagcaggttccaccaccaccgggtatcgtcagtgtcgtgattgataagcaaacaggcaagttatctaatggcgggccgggcagccgctcagagtactttatcgacgggacacaacccactgagcatacggtacatgaagttggtaccacattgatggataacggccagactcacgaactgttctgatagcagcctggtgtaaaaaacttatctaaaaagccagatgatctgatgatcatctggcttttttataaattactcgtataaaaaataagttacgtcagaaataaattcatctcacggtagtgactcatcaaaacaatcactgattcagaaaggtatgtgccaaaaaaagggcgctgacattacgggcctcgcggaaatcagcttcattaaggagtgccatcatattagcaattggccaccgcacttgcggcaatggctcaggctcatcaccttccaaactttgtggatacaggccgtgggcaataacaatattcattttgctggaaaagtaggacggtgccatggtcagtttagcgagaaagtcaaagcgctcagcgccatatccaacttcttccattaactcgcggttcgcagcttccagcaccccttcaccgggatctatcagacctttaggaaagcccaattcgtattcctcaataccgacagcgtattcacgaatgagcagtaaatcgttaccgataaccggcacaatcatcacggcctcacgattcgatggccgcatacgttcataaatgcgctgtacgccattactgaactccagttctaccgcttcaacattgaataagcgggagcaggcaaccgtttctattttcagaattttaggtttttgcaggtgtttcatgatagccccaaattaatcactcaccgccatttaacacatatctgaattaacgaaaacgcgatattatccgttaatattatccagatactttgtgtgatttttatcctcaacgtcattggctttgcaggtaggcggccagtacacgaatcccgatgagctgactcaagtcagtgattcgggtgagtacacgcagccaacacccctacaacatcaaggacaaagggtttacccacagtcattggctttgcaggtaggcggccagtacacgaatcccgatgagctgactcaagtcagtgattcgggtgagtacacgcagccaacacccctgcaacgtcaaggacaaagggtttacccacagtcattggctttgcaggtaggcggccagtacacgaatcccgatgagctgactcaagtcagtgattcgggtgagtacacgcagccaacacccctgcaacgtcaaggacaaagggtatattagaacttgatcacattgtgcgttaatgagaacctttatcgcaatgccagttagatataatttactcgtttttaacatggcggcgagctcagcccaaactcacctggttaatatttgccctacattatccctctacacacgaagaatggtttgaaaataggattatgctgatattgtgactgcgttagctttgctaccctaactcgtctacgggcaagcgctcttgcgctaggtcattttgtgagcattggcggaataggcactaaatcgttgagttattaggccatatgcctccgcacttttttatgtatttttcatagcgttgacgtaaatttaaagcgctctgatggggatgggatgagcacaatagttttaatattggccttactgttgaccagtctgatcgccgtaggtctgctgtggtggctccgattccgccgccctcaccccataacagcagcgttgccgtttgttaaaccgacacaccgaaaactcacgccagaagagcgagtgagtatcgaaaattatctgcgtaatcagcaaaataagcatggttttaacacgcaaccggcttttgattcccacgcactggcagccagtacctcatccaccccaatgttggtgctcacaccgcaaagtgataacgtctattccgttacccgcgccattacccgctatggtgtcgccagcgatgagccaaataaatggcgctattatctcgattcaatagaagttcatctgccctcggcctgggaacaatatattactcaggataatgatgttgagcttatccaaacccagacaatcccgctggtgatctcccttaatgggcatacgcttaacaatcatcagtctgagaatacctatcagcccattttaccttcagtatcgaaaaatgcgtctattcgcaaagaagatagcgaacatattgagctgcttaatatccgtaaggaaaccccggaagaatatgctctgcatggccccaatggtttaaaagaagcctgcgccatttgcatagctctattgttgctgtttttcgcattatccgggccgacggtgacactaccctggctggttatcgtggcagtgtcattaacctgttgggcgtgttggaacctcttccgccccttgtcagaaaaagatttgcgggaagtgcactgcttaaatggtacccccaaacgctggggcctgtttggcgagtcaaatcaggggcagataaacaatatctcactcggtatcgttgatctcatttatccggcgcattggggaccttattttgtacatgatttaggcaaaaaaacccatattgatatctaccttaatcgccaggttgtacgtcagggggcttttttatccctccatgatgaaatgaaaatgttcccgttacagcgctgggggaaaaacctaaccttgatcgtcggctcactgttggttctggtgttattactgatttacgtaccgctcggtctccccctaaagttgagcgttgcctggttgcaaggggctcaaagccaacaggtgaccagcgtcgcagcactggacaaaatgccactacgcatcggcgatatgctgaaggctcagggtaatggcatgtgctatgtcccccccaacattcaaaacacacgcggtttcgttttcaccccctttgattgctccggtatttattggaataccgcctcccccttgccacaacctgaatctgaaaccatagaaaaagctgcggcactggtagaaacaatcaataaacaactgcacccgcagggctctgatgccagcgtcaacccgaaactggctaccgccattgagaaatcgggcatgattttattggacgatttttctgacattgtgctgaaaacacaggcgttatgtagcgaaaataccgattgtattcgcctgaagaatgcactggttaatctggggaatgccaaaaactggtcagccttggtcaaacgggcgcaatccgggaatttggaagggatgaatgttctgctacgcccgatcagtgccgatgtactggaaaatttgattaataccgctgcgtcatcattcgtttatcgtgaaacgcatttagcaacagaagcgttgaatagcccacctccgggcggttttttgatcaccagcgatgagggcaagcagttagtgaaccaccctgcgccaacgctgcccctgtttgactacagcgcactggaacagtggcgggaattgcaacggctctcggcgttgctacttgataccccatttaaagcggaagggattattaccaatatcacgactgatgcgaatggcacacggcatattgcgctgcatagtgagccggacattgtcactctgggtcgctatctggcgaccagcctgctattgctggtgctgattttttgcctggtcgtcaatatggtcttgttgattcaacgtgccatgaaaaatcgtcgccggatggataacattcaacgttattatgacgattgctttaatcaaacgctcacaccgccccccttcttgcgctagctcacccatctccggttgatcatcgctcatgccagcagatgcacggtgtaacatggatatgctaggctagctttatctactcgcttatagcagaaaatatccaccatcacccaacgtcattggaatggaggaatggagtcgttatgccccccgattttaactggcaagaaattgataccgtactgctagatatggatggcaccctgctggatttggcgttcgacagccatttctggttaaaattagtgccagaaaccctgagccaacgcagagggatcccactcgaacaagcgcacaaaatcattcatgatgaatataacgcggtacagcataccttgaattggtattgcttcgattactggcgcgaacggctggatttagatatttatgccatgaccacggatatcggcagccgggcacgcttacgtcaggataccgtgccattcttatctggtttgcgtcagcatggtctgcaaaccattttgctcaccaatgcccatccacatagtttggcagtaaaaattgagcacaccgcccttgaccagcaccttgatttattgctttccacccatacatttggttatccgaaagaagatcaacggttgtggcaagcggttacgcagcataccgggctgaaccccgccagaacattgtttgtcgatgatagtgaagcgattttggatgcggcgcaaacctttggtatccgctactgcctgggggtagaaaaccctgactccagttgtgctgataaaacctttcaccgacacccggcaatcaatgactatcgtaaactgttgcccgctttacagttacgttgtgaataaaacagtatgacgatgggtaggcgtatttatgaaggataaaatctccccagcggaatcagtacgtctggataaatggttatgggccgcacggttttataaaaccagagcgatcgcacgtgacatggtggatggcggtaaagtccactataacggccagcgaagcaagcccagcaagctggttgaactccatgctgaaatccgtctgcggcaagggaatgatgagcgcacggtgcgtgtcttggcgttacatagtcaacgccggggggcagaggaagcccaaacattgtatgaagaaaccgaggcgagcattgccaaccgcgagaaagtcgcacaggcacgtaaactgaatgccctgacgatgccgcatccagatcggcggccggataaaaaagaacgtcgcaatctgatcaaatttaaacaaggcgagcctgagtaaactctatagatttcaacatgcaggaaggcggcaaacgaaagataaatcggttgggagcagacttgaacgctgcttacagccaggcgagtcacgaacgtagccaacaccacctgcaacttgaaagatgacggatttaaacggcggccaacatgagagaaaactatgtctaatcacgaccaattacaccgctatctgtttgctaatcatgctgtgcgcggtgaactggtttcagttaatgaaacctaccaacaggtattagctaaccatgattacccaccagcggtacagaaactgttgggtgaaatgttggtcgcgaccagcctgctgacggccaccctgaaatttgatggcgatattaccgtgcaattacagggcggtgatggccccttaacattggcggtcattaacggtaataatcggcaggaaatgcgcggtgttgctcgcgttaaaggcgaaatcagcgatgacagcacactgcaagagatggtcggtaacggctatctggtgatcaccattacacctgcacaaggcgaacgctatcaaggggttgtggcattagaaggtgaaactatcgcggcctgcctggaaaattacttcatgcagtcagagcagttaccgacccgcctgtttatccgcaccgggcatgtcgccgataaagcggcggcaggtggcatgctcctgcaagtactgccggcgcaggaacgtaatgaagatgaatttgaccatctggcacagctgacagcgaccattaaagctgaagagttattcacactgccagccaatgaagtgctgtatcgcctgtatcatcaggaggaggtgacgctatatgagccacaaaatgtcagcttccgctgtacctgctcccgccaacgttgtgccgatgccttagtgacgctagctgacgatgacgtcaccgaaatgctcgagcaagatggcaatattgatatgcattgtgaatattgcggtaaccattatctgtttgatgcagttgatattgctacattaaaaaatggcaacagcgcctcttctgaacaaattcattaatcctcgtaatgcttagccgggtacctattggtgcccggccatttcctccgtttcacacttgcgataattcgtgttccatctctcataacctagcgaaaaataggtcatatattaaaatatttgatagctatcgctgttaatcagagatgactacttacaatcgctggtagaaaattgacgatccaggagttatgacatgagtgttaaaggaattaccccgcaggagctcgccgcctatggcatccataacgtcagcgagattgtttacaacccaagctatgatttactgtttgaagaagagaccaaacccacgttggaaggatacgaacgtggcacactgacgactaccggcgcaatagcggtagataccggtatttttaccgggcgttcacccaaagataaatatattgtccgcgatgctatcactcaggataccgtgtggtgggccgatcagggcaaaggtaaaaatgataataagcctctgagccaagagatctggagccatttgaaaggtctggtgacggaacaactctctggcaaacgcctctttgttgtcgatacattctgcggtgctaatgcggatacccgcctgcaagtccgctttatcacagaagtcgcttggcaggcacacttcgtcaaaaatatgtttatccgtccatcagatgaagaactggctcggtttgaacctgactttatcgtgatgaacggtgccaaatgcactaacccacaatggaaagagcagggcctgaattcagaaaactttgtcgcctttaatctgacagaacgtatgcagttgattggtggcacgtggtatggcggcgaaatgaagaaagggatgttctcaatgatgaactacctgctgccactgaaaggcattgcttcaatgcattgttcagctaacgtcggcgaaaaaggcgatgttgccatcttcttcggtctgtcgggtaccggtaaaaccactttatctaccgatccaaaacgcaagttgatcggtgatgatgaacatggctgggatgatgatggcgtctttaacttcgagggggggtgctacgctaaaaccatcaagttatctgaagaagcagagccagatatttaccacgccattaaacgcgacgccttgctggaaaacgtggtggtgctagcagacggtaccgttgattttaatgacggttctaaaactgaaaacacccgtgtctcttatccgatttaccacattgataacattgttaaaccggtgtccaaagcaggccatgcgaccaaggttatcttcctgactgccgatgcctttggtgtgctccccccagtatctcgtctgaccgcaaaccagacgcaatatcacttcctctctggctttactgccaaactggcagggacagagcgtggcgtcacggagccaacaccaaccttctctgcttgctttggtgcggccttcctgtctctgcacccaacgcagtacgctgaagtgctggttaagcgtatgcaagcggttggcgcacaagcctatctggtcaataccggttggaacgggacaggtaagcgtatttccatcaaggatacccgcgccattattgacgcaatcctaaacggggagattgataaggcagaaacctttacgctgccaatctttgatctggcagtccctatggcgttacccggtgtgaatcccgatatcctcgatcctcgcgacacctacgccgataaagcgcaatggcaagagaaagccgaagatttggcgaaacgctttgcgactaactttgataaatacactgatacccctgcgggggccgcgttggttagcgcggggccaaagatctaagccagtgttagctgttttagtttagcgttacagggggcactttcagaattgtgccccttttttctatttatttataaaaccactgacctattgataaaaccactgacctattgataaaaccgcttatccctccatcaagccaccgctggtggcttcagactgctgacaaaccccgatgacgcgatcttgaacggtgaggataggcagaggagtaaagcatccgcgccaaggatggcgcggctcgagcctacatggatgtatttacggcgtctttacgatctgcctgttctctccgtcgcgggcactttgtcaataacctcaagccaccgctggtggcttgggcttcacatccaatggcaatggaatatatgcgcggatccgtaacccgcctcgcttactggtaccaatctccaatgaccccgcgtgcgcatcaatgattcgctgaacaattgccaggcctagcccagtaccgctggtgctgcgggcactatcaccgcgcacgaaaggctggagcaagtgcttcaaatcctcgggttttataccggggccatcatcttcaacctggaaccaagcccgctgcaactccttaccactgctcacttttatccagccattaccgtaacgggccgcattcaccaccatattggttagcgcgcgtttaatcgataatggatgaatatccaccaacacttcaccttcagctaaatccgtctcaatcacccgctcataaccactttctgccgcaatcacttcacctaatacagaattaagatcgctcggttcggtcggcatctcctgcccggtgcgcagatagtcgataaattgctcaataatcgcattgcactcttcaatgtctttattgatcgattcagacaggtaagcgtcgtcttcactcatcatttccgttgccaagcgaatacgcgtcaacggagtacgtaaatcatggctcacgcccgccatcaacaaggtccggtcatcagacaacaatttgaccccggcggccatttggttaaatgcccgtgtcaccgagcgaacttcagaagcaccgtattcccgcaacggtggcggaatattccccttaccgacctgtaaagccgcatgttccagttccaccaaaggccgattctgaatacggataaataaccaggccccacccaccgccagtagcataatggccaaggtataacggaacagcggcgagaaatcgccttggtgaatctccgtgagggggacgcgcacccagatatctggcgacagccaggttttgagccaaactacaggtgagtttttattgacctcgacccggacatcggttggcccgcccaactgctgggccatttgatcactgagaaatttataatgctgtgcccaacgtaggccactttcctctgccgccgcgttggtataaagcgaaatacccaactcacggtaaatctcacgccggaacgcgggcgggacttcaagtagtgtgccatcttccaattgcagccgatcagtcatcagcatacggacttcatacgccaacactttattgaactgttgcaagctaggtaagatagcgaaattcagcaccaccagatacgtagtgaccaaactgacaaacagcaaggtcacgatcagtaataaggttcgggcgaatgaactacgtggagaaaagcgccaccacttcatgctttattgccgtccggtacaaagacgtagcctagaccccacaccgtctggatataacgcggatgggccggatcttcttccaccatccgacgcaaacgagaaatctggacatcgatagaacgttccatcgcactgtattcacggccacgggccagattcatcagcttatcgcgggacaacggctcacgtgggtggctaaccaaggctttaagcaccgcaaattcaccgctagtcagtggcataggctcatcttcacgaaacatctcgcgcgtgcccagattcagtttaaatttgccaaacgcaatgatcgcctcttcttgtgaaggcgctcccggcagttcgtttgcctgacggcgcagcaccgcacggatacgagccagtaattcgcgagggttgaatggcttgggaatataatcatccgcaccgatttccagcccaacgatacggtccacttcttcgccttttgccgtcaccataatgatcggcatcggattactttgactacgcaagcggcggcaaatcgacaaaccatcttcgcccggtaacatcaggtcaagtaccatcaggtggaaggactcacgagtcagcaagcgatccatctgttcagcattagccacactgcggacctgaaaaccttgctccgtcaaataacgttcgagtagcgcacgtagacgcatatcgtcatcaacgaccagaatcttgtgattctcttgcattttattactcccaaaggccgtattgcctggatctgcacattgttagaaaaacttactctaacagacagttattaatggtataaattctagttgaaattgttacaaagcttattcgtatgcttaattatcaaacgcctaattatcaatatcttcattaaatggcctatcttcatcaaatggccgataacgaatctctaatatccaataggttgcctcaccattaggcgtttgcacggtgacctcgtcatcgacttgtttccctatcaatgcacgggcgaccggtgaatcaattgaaatccattttttggccgggtcaaactcatctggccccaccaaacggaagatgcgttgctcttcttgctcattttccacccgcacccaggccccaaaaaagactttaccttcctggcgaggatcgggatcaacaattttcagcacttcaaggcgcttggcgagaaagcgtacccggcgatcgatttctctcagccgcttctttccataaatatattcagcattttctgaacggtcacccatagcagcggcttcagaaaccgcctgagtgacgaccgggcgctcttctcgccacagataatgcaattcacggtccagcgcctgccagccttcgcgggtaatgtagttactttttgccataatcgttactttttgccatcgtcgctatttttatcatcgttgttatcttcaccataatcgttatttttcatcaagttagccatttttcattataataactaatttctaccgcaacgttatccacttggcatcaatgccactactgtaaccgattctttttatggattcgtcgttttacaaataagcagcctttcacataaaccgtttctacagaaaagtaggttgtagataaataaattgtgctgatgtccacgttacctcaagcccaacgagcgctctactggcattttacctaagcaatccgtataactgtcttttatcgtttttcctactcactttatactcagagcacttggcgttgcaggtaggcagcaaacgaaccaatcccggtaaacctatcgagcagtagaacttatctcaccgtaaagtctactacaggtaagtgattcgggtgagtgagcaccgctaccccctacggcctcaagtacaaagggtaaatcaaaattgatatcagacttatgaatgaaccactgagccgcattattgcaagcgaactgcaggcccggccggagcaagttatctccgctatccgcctgcttgatgaaggtaataccgtgccctttatttcacggtatcgtaaggaagttaccggcgggttagatgatatccaactgcgtcagttggaaagccgtctggggtatctgcgtgaattagaagatcgccgccaaaccattcttaaatcaattgaagatcaaggaaaactcaccgaccagctggccggggcgatcaacgccaccctaagtaagaccgagctggaagatctgtatcttccttataaaccgaagcgccgcactcgcggacaaattgccattgaagccgggttagaacccctggcagagcgtttatggcaggatccacaacaagaccctgaacacaccgcgctggcctatgttgatgccgataaaggcgtcgctgatactaaagccgcgttggatggtgctcgctatattttgatggagcggtttgccgaagatgccaccctgctggcgaaagtgcgtcagtatctgtggaaaaacgcccatctggtgtcaaaagtcgtggaaggtaaagagcaggaaggcgctaaattccgcgattacttcgatcaccacgaacctatcgcacaagtcccttctcaccgcgcattggccatgttccgtggccgcaatgagggggtactgcaactggccttggatcctgatccgcaatttgacgaaccgccgcgtgaaagtcagggtgaacagatcattatcaaccatcttgatctgcgcttgaataatgcgccggcagacggctggcgtaaggcggtggtcaactggacctggcgtatcaaggtgctgttgcatctggaaaccgagctgatgagcaccttgcgcgaacgggctgaagatgaggctattaatgtctttgcccgtaatatgcaagatttactgatggccgcgccagcaggtatgcgcgcgaccatgggcctcgatcccggcctgcgtactggcgtgaaagtcgcggtggtggatgcaacaggcaagctggtcgctttcgataccatctacccacacaccggccaggcagcaaaagccgccgccgttgtcgccgccctgtgcatcaaacaccaggttgaactggtggctatcggtaacggtactgcctcacgggaaaccgagcgcttctttgtggagctacagcaacagtacccggccgtcaccgcccaaaaagtcattgtcagtgaggccggtgcctcggtctattcagcctctgaattggcctcgcaagagtttcctgatctggatgtctccatccgtggcgcggtttccattgctcgccgtctgcaagatccgttggctgaactggtaaaaatcgatccaaaatctatcggtgttggtcagtatcagcacgatgtcagccaaagccaattggcgaaaaagctggatgcggtggtggaagactgcgtaaacgccgttggcgtggatttaaacacggcttcggtgccgttactgacacgtgttgccggtttgacgcgcatgatggcacagaacatcgtgaactggcgtgatgagaatggccgcttccgcaaccgtgagcaattactgaaagtcagccgcctcgggccgaaagccttcgaacagtgtgcaggcttcttgcgtattaaccacggcgataaccccttagacgcctcgacagttcacccagaagcctatccggtagttgagcgtattttagcggccaccgagcaggcgttgcaggacttaatgggcaatgccaatgcgctgcgcaaccttaatgctcgcgattttactactgagcgttttggcgtaccaacggtaaccgatattctgcgagagctggaaaagccaggccgtgacccgcgccctgaatttaaaacagccaccttcgcggaaggggtggaaacactgaatgacctgacaccgggcatgatccttgaaggcgcggtcactaacgtgacaaattttggtgcttttgtggatatcggcgttcatcaggatggtttggtgcatatctcttcactggccgataagtttgtcgatgatccacataaagtggtgaaagccggcgatatcgtcaaagtcaaagtgatggaagtggatctgcaacgtaagcgcatcgccctgaccatgcgccttgatgagcagccaggtgaaactcactcccgccgatccaacaatggcacgggtagcgagcgcaccaataatgacaaccgcggggtaaatcgcccacataacgacgcgaaaggtcataatgcgcctaaccgtgctccggccaaagggcgatcagatagcagctcggcgggtaacagcgccatgagcgatgcgctggcggcggcctttaaaaagcgttagtccctgacaaggacggccattaaactgcccccctcattattagattgatatccaataatgaggggggcagtttaataatttaacaaaataattaatccctcctgatattctcattagtttataaataattacgatagcattctatgcgttaattaaaactcaaatgttacctgattaaaaccagtgtgattcaataatgttactcatcggtattttcaatttcagcatagacttacagaaagattcattaactgatttagtacatcattctcatttgcgatctcggtaatttgatggtaaaacaagagataaataggaaccatactcattagttacagaaataagacattaactagagaaataatactgtaataagtggttactattggaaggctttatttaattgagcatgaaaataattctcagtattattatttaaatcattatcttttaatttgctcgttttggctgaatgtttggtacaccgataacggtaatttatccaaaatttcaagaggcttatatgcatcttatcccccaacgatcctacaaaatcattggtttttctcctgaaatcagcccagcttaccggcaaaaactcttgtcattgggtatgctgcctggctcctcgtttaatgttgttcgccttgcgccgttaggtgatcccattcagatagaaacccgtcgggtcagcctggtggtacgcaaaaaagacttagacctgctcaccttggacctgcaaccccaataactcaggtctgcgccctatttctatctgcgctacggtttgaaaaaatagcctcgcgcagtttgattttaatttattgatatcacgttggatcatgaaagcactcactatcggccttatcggcaacccgaatgcgggtaaaaccacgctgtttaaccagttaaccggcgcccgtcagcgggtgggtaactgggccggggtcacggtggaacgcaaagaaggccacttcaacaccgcccaacatcaggtgacattagttgacctgccagggacttactctctgaccaccatttctgagcaaacgtcgctggatgagcaaattgcctgtcactatattttgagtggcgaagctgacctgctgatcaacgtgattgatgctgtcaacctggagcgcaatctctacctgacactgcaactgttggagttaggtatcccgtgcatcgtggcgctgaatatgctggatatcgccgaaagccagcatatcgaaattgatatcaacacattatctaaaaaactgggttgcccggtcattccattggtatcgacccgtgggcgtggtatcgatgaattaaaaaacagtattgatcagtttcaacccgccacttgccgtgcgctggtgagctatccccccattctgctgagtgaagtggataaactggtcgccgcgatgtccgacgccttacccatgcagcaacgccgctggttagcactgcaaattttggaaggggacatctacagcctgaaccgggcgggtgtcgcgccctcaatggttgaacaagcccgccaacagctacgtgaacaacagcacgaagatccggcgctgattatcgcggatgcccgttatcaaagcattgctcacctgtgtgaggccgtgggtaattcacagcaggcagagcctaaccgcctgacacaagcgctggatagcgtgatccttaaccgttggttaggggtaccaatattcctgtttgtgatgtatttgatgtttgtattggcaatcaatattggcggagcgctgcaacccatctttgatatcggttctgccgctatctttatccagggtttgcaatgggtcggtcatacgttgcacttcccaccatggctgactattttcctcgcacagggtgttggcggtgggattaacaccgtactgccattagtgccacagatcggcatgatgtatctgtttctctcatttctggaggactcgggctatatggcccgcgccgcgtttgtgatggaccgcttaatgcaagcactgggattgcctggtaaatcctttgtaccgctgattgtcggtttcggctgcaatgtcccctcaatcatgggggcacgtaccttagatgcccaacgcgagcggttaatcaccatcatgatggccccgtttatgtcctgtggtgcgcgattggctatttttgcggtcttcgccgcagcattcttcgggcaggacggagcgagtatcgtcttctcactctatctgttagggattgcggtcgccattctcactggtctggttctgaaatacaccattatgcgtggtgaagcctcgccgttcgtgatggagctgccggtttatcatgtgccacacctaaagagtttgttattacaaacctggcaacgattaaaaggttttgtgctacgggccgggaaagtgattgtaattgccagtatcttcattggcggcctgaatagtttctctttcaacggcaaacccgtggacagtatcaatgactcagccttggcctcagtcagtaaagtgcttacgccattgctgatgcccatgggtatccatgccgataactggcaggcgaccgtcgggctagtcactggagccatggcaaaagaagtcgtggtagggacgttaaataccctttataccgccgagcaaattaacaatgatccctttgatgcagaaaactttaatttactggatgagttagcaggtgccgttgatgaaacttggcagggcttaaaggacacctttagtcttagcgtgcttgctaaccccattgaagccagtaaaggtgacggcgagatgactaccggttcaatgggcatgatgagcagtaagttcggttctagtatctctgcctatagctacctgattttcgtgctgctgtatgtgccttgtgtctccgtgatgggggcgatagcgcgcgaaaccagccgtggctggatgaccttctccatattgtgggggttgaatgtggcctactcgttggccaccttgttctatcagggggccaccctccgcgatcatccacaggagagcctgagtattattgcgttagtcattgtggttaatgcgttgatcttatttggtttacgccgtgcccgtagccgggtcaccgtcagattacaaaacagtgaacctgctaatggctgccgaagtagtggcagcaactgccattgatcacccattagccagccgtaaaaagagggggaacgatggccagcctactgcaactacgtgatgcgattgccctcaacggcagcgctgaagccagccagctaagccggcagttggcaataccgttgcccttggtcaacgccatgctggagaagttaaccgccatggggaagatagaacgtattgagttggatcatagcggctgcctgacaggcagttgcaaaagctgccccgaaggccatcagcactgtaatactgtgatctatcagttaaaagaacctcacgcacaccaataagagatgcccatatgggcatctcaacatgttgattccgtattatttacaagccaacattgataagccattttttataaacacttacctataaacatttacttataaacatttatttataaacactgacttataaataattatcgataaataattacttataaacctcggcgtcagcatcaaacttccccttctcacgttcggcgataatcacataatatttaccgcccttttcgtctgccagttttgacagcgcttttttaacgtccattggcgacgttgcctcgcctgtggtactgaccgtacctatcttctcgtaattattggcttctgcttcttgtttagtaatttccttggcagcaatagcggcgaaagagagaccactgatcaccaaagcaacagccatatttttcaatagtttcatatgaaacacctcgtattggataacctccgctttaacctttctaattattaaacagattcaatatttatccatttaataacttaaataattttcttttacacaaccattttacccaaccaatataggctgggcagtaaaaatagagagagaaaataagaagctaacgccattattttttgttttcttcagcaaaattcaggattaatttggcgaaatcattggggtgagaaataaagggggcatgagcagccccttgcatgaccaccgactgggtttgcggccaggcgctgtctaatagcgatgccactttacgtgggaccaaactgtccagatgaccgtaaacgcgcataaaaggcagcgtaaaaccagacagtgctgtacgtagatccgccgtgcgcaagatctccaaccccccggtcaatacctcaacatcgggcatttgatgctgtagcacgacagattttagcaaacgggcatcctgacgcgaactttcagtccctaaggtttgcaaggccaaaaagcgttctactgtccgatgaaaatcatcacttagctgatgttgaaaacctgccagcacttccggcttgatacccggccattcatcacgcgcggtaaagcagggagaagaggagacggtgatcagccccctgacacactctggctggctcagggctatttggctagcgaccaatccccccattgaccacccaagccacaatgcctgtttcggcgcttgctgtgccactctctcggccatgtcagccagtgacatcgcaccataatcttggctgcgcccataacccggcaggtccaccaaatgcagacgaaaatgcggcgcaagtcgatcaataatgcaatgccataccccgctattcagcccccatccgtgcaacaacacaagatcgcaatcgccttcaccgcaggtgtaccaataaagctgcttcatacagtaatatcctgttgccataagaataacagccctgtcaggtgatttagctcactaaaagggcactaaaatcaaggaagatacctatgctaacaaccgttagccagtgttggctatgccagcagcctttgtatcacaatcgacacggtatttgttgttactgccagcgtcatctaccggtgttacctccctgctgcccctgctgcggtttaccttccaccagtacattcctgcgctgtggccgctgtctgattgccccaccgcgctggcaccatatgacgttcgtgggtgattatgccccaccactgagcgggttgattaaacagctcaaatttggcggagccccccaactggcccccgtattggctcgtctattattattacgatggttacggcactggcgggagacccaatgccgtaagagtgataaggccatcaagccacaacggatcgtcagtgtgcccctgcatcattggcgctgctggcggcgcggatacaaccaaacggatctcctggctcgtccactggcacactggcttggttgcgattacaccccactgacgctacagcgtatacacgctacgccgccgcaacagcagctgacggcggcacagcggcgaaagaacgtgcgcggaatttttcgttgtgctgagtcagtacgggggcaacacattgccctgctggatgatgttgtcaccaccggtagtacactaaatgaaattgcccatctgctatgggctcagggtattgcctcattacaaatctggagtgtctgccgaaccttgtagtcaccctagcaatgggcgtattataaccgacaagagtagtcaactattgagcagatgccatgatcacaataacagacgcagcacaatctcattttgccaaactgttggcaaatcaagaagaaggcacccaaattcgtgtatttgttatcaatccagggacaccaactgctgaatgcggtgtttcctattgcccaccggatgcggttgaagcaacagataccgaactgaaattcgagcaattatcagcctatgttgatgaactgagcgtaccttatctacaagacgctgaaatagatttcgtcactgaccagctcggctctcagttaaccttgaaagcaccgaacgctaaaatgcgtaaagtagacgatagcgcgccactgatggaacgggttgagtatgttctgcaatcgcagattaacccacaattggctggccacggtggccgagtgacactgatggaaatcacaccagaggggttggctatcctgcaattcggcggcggttgtaacggttgctctatggtcgatgtcactttgaaagaaggcatcgagaaggagttgttgcagaaattcccagaattgaaaggggtaagagatttaaccgagcatcagcgtggcgagcactcttattactaattaattaccctttgtcattggcgctacagcggcgttacctgcgctcactcacccgaatcacttacttatgtaagctcatcgggctttgcttgccgccttgctgtaacaccaatgacgttgggtcatctctttcttacctggcgctacaacagcattacccgcgctcactcacccgaatcactgattacccaaccgaaacgtttttgcgccgcttatccaaatctttcaataaacgattaatctggctatcggcaaatatctcttccagagacgctgacaatttacgccgccagttagggtactcgtcagtggtaccggggatattcactggtgctgccatatccaaccaatcttctggttgtaaccccagcaatgcactggcgctatccgcaacatagcgctgcaaaccacggttcagtactgggctcatcgataacagtgccgctttgtggcccacttttttcggcacacaatcgtaacgatgtaacccttctaataacccttgtttggctcgctctctgtcaagatagagctgcttcaaaatctgttgatccggatataaccccagcttattccccaaagtcagatcatcagcttgccagtaaccgcgcagtgtcggcaaatcatgggtcgtaatggtcgccatcgcctgcaccgggtaagactgtggcgcacggaagatattctcactgtcatgctcaaaatagagcaccttgtaggaatacaccccgctatcacgtaacttgcccacaatctctaccggtaccgtgcctaaatcttcaccaatcaccatgcaatggtggcgctgactctccagcgctaataccgccagcaaatcatccactgggtattttacataagccccctgatcggcggtatgcccgtaggggatccaccacagacgcaataatgccatgacatggtcgatgcgcaatgcgccacaactggtcatattggcacgcagtaaatcaataaaaggctgatacgcgcgcgcgaccattacatgagggtccatcggcggtagcccccagttctggcctaatggccccaagatatctggcggggcacccactgatgctttcaggcaatataactcgcggtcacaccaggtttcagcgccaccttcagcaacccccaccgccaaatcacgatacagaccaatcggcattttccgctgttggctggattggaagcagtcatcaaattgactggctgccaaccactgtaaccacagatagaacgtcacctcgtcagcgtgttcgcgacaaaaatcagccaccgcactactatgaccatcacggtacttctctggccacactggccagccccacatcatcggatcatgctcacttaaatgcgcatgtagggcatcaaatacggcctgctgatgtaaactgctcccgccttgttcaacaaagtgccgaaatgcctgcacctgtgcatctttggctttacgggcagtaaacagtgggaaggataagcgcaaagccgtcaatttaagctgcataactaacgggtaatcaacccactcgctctcccgactttttgccaacgcctgttgcgtctcagcttgatgccaccaacgctgcgcggcttcactttgctgaaactcctcgaccctattgatgtcgatataaatcacattcaaccagcgccgggatgacgggctgtaagggctagcactatgcgggttggccggatataacgcatggatagggtttaaaccgataaaggacccaccacgctcaccgacctgctctaacatctgctttaaatcaccaaagtcaccgataccccaattatgctcggaacgcagggtatacagttgtacgcaagccccccacagtttttttccctgcagcaaagcatcaggctcatagcagcgtttcggtgccacgatgattgaacactgccactgctgtagatcttgttccaatatcaaacggtgataacccagcggcaaagaggccggcaatgtcagcgtttttttcgcactgatacgcccctgatgcagctcaccgttctcagtctgtaactgccagtgataatcgccagaaccggccattggcaattgcatcgggctaccaaacgtaaacactttaacgaccggcaaaggggtattcgctgtctgagtgtcatgagcaccaagagaacgccccatggccgccaacaactgctctttggtttccgctaacgtcgcctgcggtttaccatgcgcattaatgtaactggcagctatccctgccagtgttgctgcttgatcgagcgatttacgatccatgcagtcttctccttaacgtttggcttgccaaattcgctgttgataatcgcgaatagaacggtcagagctgaacatcccgactcgggcggtgttaagaatggcacggcgggtccactcatccttatcacggtacagcgcatcaatttgtttctgcgcctggcagtaggaggcaaagtcagccaataccagataagggtcgcccccctctaataagctgtgcaacatcatgtcgaatgcctgcttatcaccctgactgaacgcaccactggccaattcatccagaatacttttcagatgtgggtctgctttcacgtatttctttggctgataccccttcgccagaatggctttcacttgatcaaccgtgtgaccaaagataaagatattctcatcgcccacttgctcggcgatttcaacgttagcaccgtccagcgtcccgaccgtcaacgccccatttagcgccattttcatgttgccggtacccgaggcttctttgcctgctgtggatatctgttcagatacatctgctgcggggatcatcaattcggcgacagaaacacgatagtcggggataaacaccactttcagacgatctttaacgatcggatcattgttgatcttgtcggcaacctgattaatcgcataaataatattcttggctaaataatagcctggtgcagctttggcaccaaacaggaacacccgtggtgcgatatccagtgccgggttgtcacggatctggcgatacaacgacaagatatgcaacaaattcaaatgctgacgtttatattcatgtagccgtttaatctgtacgtcaaaaatagcgtcgggattgataaccagccccataacgcgcttgacgtaatgcgctaatttaaccttgttatcatacttaatctgctgataacgctgacggaaagccggatcctcagcgtagggttccaagtcttgcaaaacatccagatcgttggcccattccaccttcaaggtgtcatcaatcaaaccagagagtgccgggttacattgtttcaaccaacggcgcggcgtaataccattcgttacattgtggaatttatttggccacaattggtaatactcagggaacagatctttgataatgagatccgaatgcaactgggcgacgccgttgacagcaaagccgctgaccacacacagattcgccatccgcacctgtttattatgatgtaccgccagtttggcccacacctcgtcattgcctggccactgtttgttcaccagctttttaaactgcgcattgatctgcttgatgatgacaaaatggcgtggcaacaaactgcgtaccagtttttcatcccagcattcaagggcttctggcatcaacgtatgattggtataagcgaatgttttgctggtaatcgcccaagcggcatcccaactgagttgatgctcatccagcaggacccgcagcatttccgggatagcgattgttgggtgggtatcgttgagctgaataacttcatagtccggcagttcagccagtttacggcccgccaaatggtgcttccgcaaaatatcggcgaccgaacaggcacactggaaatattgctgcatcaggcgcaggcgtttgccggccagatggttatcattcgggtacagtactttggtcagtttttctgcttcaacaccattttgttccgccagcaagaatttgccatcgttaaaaagggttaaatcaaacggatgctggtgcgtcgcctgccacaaacgtagcggttgtgtcacgccgttacggaaacccaacaccggtaaatcccacgcttcaccgcgcaaggtaaaggccggacgccataattggcggccatcggcttgcttgaccagattaccgccaaaccccacatcaacggccaatgccgcattgtggcgaaaccacgggtaactctcccgctgccaattatccggcgcttcttgctgtttacattcacggaaagactggcggaacaggccatattgataattcagcccatagcccgttgccggttgctcaacggttgccattgagtcaagaaaacaagccgccaaacgccctaagcccccgttgcccaatgctgggtccgtttcttgctctaacaaatcactcagcttaacctgctgctccgctaacagcgcgtccaccgtgtcataccaacccagattaattaggttattagctgtcaaacgaccaattaaaaactccatcgaaatgtagttgacatggcgttgtacattttttggtttgctcggtgcgggctgagcagataactgttcggctaacgcagcgctgacagcttcccaccattgatacggggtcatttgctgagcggaggttaagccaaagcgctgccactggcgagtcagggcggccagaaaatcgtcctttttaagcataggctgtgacatagggaggtctctatcctgtgaatgggtaattttacccgtatcctgccaatgagtactggcaagagcatcatcccgatgagggattagctggggaggagccgcagggcgtagctaaaattgtgatccgtagcaacttacagccataggaaacattaacgctattgcattaatacaaccattatcagaccttagcagtgatgattaattacggggctaaaaataattactcttatgaatgcctgtcactttttccgacatattgatacgttaacccttggggatttttctaaccaaatatcttttccagcggacacagaatgctgattccatccaaactgagccgcccggtacggctgcaaaataccgtagtacgtgaccgcctgctggttaaattatccagtgccgctaactatcggctgacgttaattaactgtccggcagggtacggtaaaacgacgctcatcgcccagtgggcagccgatcaatccaacctcggttggtattctctggatgaaagcgataaccaatcagaacgctttgccacctatctgatcgcggccatacaattagcgactggtggacattgcagcaaaagtgaagcactcagtcaaaaacatcaatatgccaatctctcggcgttgttctcgcaattatttattgagctgtccaattgggacggccccctttatctggtcatcgatgactatcatctgattaccaatgacgctatccatgaagcgatgcgttttttcttgcgccaccagccggaaaacctgacgctgatcatactctcccggaccttgccatcgctgggtattgctaacctgcgagtgcgtgatcaactgctggaactggggatgcagcaactggcgttcaatcatcacgaggcgcagcaattctttgaatgccgactgtcttcgccactggagcaaggtgacagtagccgcctgtgtgatgaagtcgaaggttgggtaaccgcactgcaactgattgccttgtcatcacgccaacccaattcctcagcacaaaaatcggctaagcgcctggctggtctcaatgccagccatctgtcggattatctggtcgatgaagtcctggatcaggtcgatagtaaggcccgtgcttttctactgcgttgctctgtattacgctcgatgaacgatgccctgattgttcgcctgaccggtgaagacaacgggcaacaactgttggaagagctggaacgtcagggtttgtttattcatcgtatggatgacagtgctgaatggttctgtttccatcccttatttgccaccttcctacgccagcgttgccagtgggaattagccttggaactgccggaattacatcacgcggcggcagagggctggatggcacttggctatccggcggaggctatccaccacgctttagccgccggtgacgtcggcatgctacgcgatatattgttgcaacatgcctggtcgttattccaccacagcgaattggcgttgttggaacagtgcctgacggccctaccgtatccgctcttagtccagaacccggaactggccttactacaagcctggctggcacaaagtcagcaccgctacagtgaagtgaatactctgcttgagcaggcagaattagccatgcaagaacgtaagatcccggtagatgaaatcttacgcgctgagtttggtgcgttgcgcgctcaggtggctatcaacgcgggtaagccggatgaagcggaaaaattggcgaccgatgcgctaaaatatctgccaatggcgcactattacagccgaattgtcgccacctccgtgactggcgaagtccatcattgtaaaggggaactggcccgcgccctaccgatgatgcagcaaaccgaacaaatggcccgccgccatgaagcctatcactacgccttatgggcattactgcaacaaagtgaaatcctgattgctcaggggttcctgcaagccgcttatgagacccaagagaaagccttcgaattaatacgtgaacagcatcttgagcaactgccaatgcatgagttcctgctgcggatccgctcccaggtattatggtcatggtcacggctggatgaggcagaagaagcggcccgtaaaggggtcgagattctggctaactatcagccacaacagcaattacagtgtctggcgatgctggcgaagtgttcactggcccgtggcgatctggataacgccaacgtgtatattcagcgctgtgaagccctgcaacatggtagccagtatcaccttgattggataaccaatgcggataaaccacgggtgatccattggcagatgaccggggataaggtggccgcggcaagctggctacgccagacagaaaaaccgggcatggcggataaccacttcttgcagggccagtggcgcaatattgccagagtacagataatactgggccgttttgatgaagctgaagtggtcttagatgaactcaatgagaatgctcgccgcttacgcctgaccagtgacttaaaccgtaacttgctgttaagcaacacgctttattggcagacagaacgcaaaggtgaggcacagaaagcgctgattgaatcactgaccttagccaaccgtaccggttttatcagtcattttgttatcgagggcgaagccatggcgcaacaactgcgccaactgatccaactcaatgccttacctgaattagaacaacaccgcgcgcagcgtattctgaaggatattaaccagcaccatcggcataaattcgcgcatttcgacgaaatttttgttgataaattgctcactcatccacaagttcccgaactcatccggaccagcccgttaacacaacgggaatggcaagtattgggactgatctattctggctacagtaatgatcaaatagccaatgaactggatgtcgcggccaccacgataaaaacgcatatccgtaatttgtatcaaaaattgggcgtcgctcaccggcaggaagccgtacaacaagcccaacgtttattgcagatgatgggatatgtctaacgggcgcacacgtgtttgatgatatgaccatgagagggtggctcggaccaggcgacagtttaaataagtttaacaatcagtcgattaaaataagaccattcttgtataaagccagagatggctgataaatcgccctgagaaaaatttatccacgatacggtttaccaacacaactttttatcaatgataatgtgtcattctggtaaaccgtaatctcttattcgtcgcggaggcctctctgaaaggctggcaaccgattaataaccactttattttatgggtctttattggcgataatatggatctttattgacgataaattgattacaatggcgctcttgcgtattcaatcgtcattaagggtcatcagcagtatggaacaatttgaagcaatcagtgttgagcaggcttatctccgttggaaagagggtaaaaccgcattggtcgatatccgcgatccacaaagttacgaagccggtcatgcaccgggcgccttccatctgaccaacagcagcctgcacacttttatgcagcaaacggattttgatcaacccgtgatggtgatgtgctatcacggtaatagcagcaaaggtgccgctcaatacttactgcaacaaggctttgatgtggtttacagtattgatggcggttttgaagcctgggccagaagctatccgcaagacataaccagtgaatctcgttagacggtaaataaaataatatgactcgagtgatagtaatctctaacctacgtctggcgcaggcctttgtggattatatggccacccaccatgtggcattagaaatccggccagacgctcaaggcgttgaaatctggttggccgatgatgagcaactttctgccgtccaacatgagttggagcaatttctactggatccacttaatccacgctatcaggccgccagttggcaagctgggaatgtgaattcaaatctgccctatcagcgtttttcttacctccaaacattacgcagccaggctgggccgttaacgctaagcgtgatggtgttgtgtattgccatctatattctgatgctcattacgggggatatggcggtaatgtcctggctggcatggccctataacagcagccagtatctacaaatctggcgttgggtcagccatgccttcttgcacttttcactgctgcacatcctgtttaacctgatgtggtggtggtatctgggcgggcagatggaaaaacggcttggcaccagcaaattgctggtattaactatcgtctcagccgtcttcagtggctgggggcaatcactcttcagcggtgccaactttggtggtctatcaggtgtggtttacgccttaatgggctatgtctggctgaccggtgaacgcgcacccgagcatggtatctcactgccccgtggcttgatggctttttctgtgctctggctgatagccgggtatttcgatattttaggcttgtcgattgccaatgcagctcatgtttctggtttgattattgggctactaatggcattttgggatacgcgcaacagcgcgagaaccgtacaataactgcctggccaaccaggcgcattaggggattatcgtgaagcaaacgcagcggcatgatgcgattattgagctggtacgcctacaaggttatgtcagcactgaagagttagtggaacattttgccgttagcccgcaaaccattcggcgtgacttaaatgagctggccgatcaaaacaaaattcatcgtcatcatggtggggcggcgctaccgtccagttcggtcaacgcggcttataacgatcgtaaagtgatgtggtcggaagaaaaggcgcggatcgcccaacgcgttgctagccagatcccagatggcgccacgctatttattgatattggcaccacacccgaagcggtcgctcatgcgctgatgaatcataaaggtctgcgagtggtcaccaacaatctgaacgttgccacattgctgaccgccaaagaagactttcgccttattctggcgggaggcgaggtccgcactcgcgatggtgggattattggcgaagcgaccctggattttatttctcaattccgtcttgattacggcatcctcggtatcagtggtattgatatggacggttcattactggagtttgattaccatgaagtgcgcaccaagcgagcgattattgagaactcccgttgtgtgatgttggtaaccgaccattctaaatttggccgtaacgcgatggtgaatttagggaacatgaatctgatcgattatctgtttaccgatcaacagccaccagccagtgtgatgaaaatcattgagcagcatgaggttcaattggagctttgttagcgtttgggtttgatcttggtggtttggatcgggttcggtgatcgggttcgattatttgagtcggtgatcgggttcggttgttatggcttcacagctcacctggcctccgatgaaccaaccgccaatggggccataagcgtggcccccttggaaccccgcgctttcgcactatcgcttgcccactgcgtgggttccctcgattcatcatttcgctgacggaccgggccgattcgcttcctgctcaagcggccctcgctcggcatccatgcctcgcgtcctaccttcattcttcactcggctgctcaaatgtgctttggacgtcaacaacccattcaaaatcaaaatcaaaatcaaaaagttattaaaaatctaaagatgatggtctggcgtcaatcggctgctcaaatgtgctttggacatcaacaaggagagagagggtacaaaaaatttatcggtgtcattcttttgttaaccgaatttgattgtgcgccttatccacccagagatagaaagtggattgtgtcgtttcgcttggtagtgaccacacttcactatcaccaaaatttggctttggcgttcatacccaagactgttgagataattttttaaagggctagcatcgagcgtatgattaaatattattgtacttgatgggttataaccgtcccctggttgatactcaaaataataatcacgggtaatcttcggcgttttttcaatatcacgatcagtaagcatgtgatattttataaaatcatcctgagtgtatacgcttttttcattaacccctgcagcaataaaagataaaaaaaaccaataacgcctaaggtgacaaatatatagcttgaagccaaacgggtttgtgccctgtgaaacacggtcactacgcgagaaaaacaattttattcgcgtttcattttaactatcttgccatttttctctaagcgatacattccatcgtaaacgctaaacaatatatctttatttctgtcattctcgacagagaaaaccttgtttttatcaatgcaattcttactggttttcatatcatcaaagcatcgtctgtcatatttaccctcttctttatagccgtcgccaaaatcccaaaatataacagtgtaaaaaccatcagatgccggtttgggaatactgtatttatccttcagcatatccctattttccagccaccagtttattttacttttatcagttaaagggaagttcctcactaaaacatcactgtaatcatttctctgatgaacagagacaatttccaccggatgcagtaacaaccagaaaacataacccagtaaagcgctgcccgtcagtaatagcgcccagagattttttttactttttactttcattgcggctcccggcaatctctacggtggcttccatattggtcataaatggcttgaaactaaactggttgaatcgttggagaacaaaccctatgcggaataaattgaacccgttaaacgtggaattcttaatattatcattatctaaataactgcgcttaatagtgctccactttcgtcatcccttgcgagaaaagggattggatcagttttaccgccaaatgctatggtgttaagctttaacaaccgaactgatcatcaacatcttccgggcccattatcaggcctatcttaccgaattcaccataattttaatagtatcttttataagccatataaaacgggacggaatatgacaatgaaaaaataaaaggaattaatactgcaataaaaaccccaccgctgtctattgttatattaaaaataggtaaagcccccgtctttgcaacgttgaaatgatacttagcacaccctaaaatcagaaaggatgagacaacatttaagataaaatgcttagagtgtaataggtggctgaccacataataaaataggagcaatgaaaatactgtacagatgatgtaagtagaaaatgaaaacatatgaaccatattaatacgacctgtactgactgactgccatattcatattacctgcagatctctcatatattgattcagataagcttatcatctatataccctctagattcagggtttcgttccagatactcttctaatacatccatgataatatccctattttttactcaacttttatataagataaacatgatgtaaatcgatatcaatagattaattctggcgatcagagcggattccgattgaggctgggccaagtgaataccgaactgatgacaaccctatccctcttcttttgaaccctgcatgggctagcctcctcaataaaaacatacctcaagtaacacatatcaataacaaaaatgttacctccatcacgcataaatgtttttcttcggttaaatcttggcttatttgttggtttttgattacaatcgtgagcgaaaacgaacattaaagcgctgtttcgaacattcagaggaaggtaacatggaaaccaaagacttgatcgtgatcggtggcggtattaacggtgccggtatcgctgcggacgctgctgggcgtggcctgtcggtactgctgctggaagcgcaagacttggcctgtgctacgtcttccgccagttccaaacttatccatggtggcttacgctatctggaacattatgaattccgcttggtaagtgaagccttggccgagcgtgaagtgttactgaaactggcaccgcatatcgcattccctatgcgcttccgcctaccccaccagcctcatctgcgcccggcatggatgatccgcaccggcttgttcttgtatgaccatttgggcaaacgtaccagcctgccagccagtaaagggctgcgttttgggccggaatctgtgttaaaacccgagttggtgcgcggtttcgaatattctgactgttgggtggatgatgcccgcctggtggtgctgaatgcgcaggaagtggttaaacacggcggtgaagtccgaacccgtaccaaagtgacccgtgcctggcgtgaacaaggcctatggatggttgaagcccttgatgtcaatactggcaaaaccttcacctggcgggctaaaggcttagtgaatgccactggcccttgggttaaacagttcttcgacgatggcctaaagctcaaatcaccttatggcatccgcctaattaaaggcagccacattgtggtgccccgggttcataaccaaccgcaggcgtatattctgcaaaatgaagatcaccgtatcgttttcgttatcccttggttagatgactattccatcatcggtactaccgacgtggaataccacggcgatccaaaagaggtgaaaattgacgatcaggaaatgacttatctgctgaaagtctataacgaccactttaaaaaacagttgggtcgtgacgatatcgtctggacctactctggtgtgcgcccgctatgcgacgatgaatcagattcaccgcaagccgttacccgcgattacacgctagatgtggccgatgaagcgggtcaggcaccactcctgtcggtcttcggcggtaaactcaccacctaccgtaaattggcagaacatgcgctggaaaaactgtcagcgtactacccgaatgtcggcccagcgtggactaaaaccggtgccttgcccggtggggatattggcggtagccgtgatagctataccgtgcaattgcgccaccgctataactggttgccggaaggattggcccgccgctatacccgtacctatggtagccacagcgagctaattttagccaatgcgacccgtcttgaaagcctgggtgagcactttggtcacggcttgtatgaggctgaattgcgctatttggttgagaacgagtgggtcgttgagctggatgatgctatctggcgccgtaccaaattaggcatggccctcagcgatgaagagaaacagcgggtagcccagtggctggctgatgcgcacactgaaaaacaacaggcgctgccgctggtttcttaatagcaaagtttaacattgtttaactttcgttaatttttgcctttctgggctgcatagcgttgttcaagcatctcaagaaatttaaaaaccctcttcatcggataaccgcgaagagggttttttacggtggcactggcggttgaatatgccattaccgcacactacagccggataggcttaatatgccaaatctcatcggcatactccttaatcgtccggtctgaagagaaataacccatattggcaatattcagtaaggttttacgcgaccattcatcccggttgcgatacagcgcatcgacttgctcttgagtgtccacatagctgcgataatccgccaatagctggtagtgatcccccaaattgaccagcgaatcaaacaggttggtatagcgatgaggctcttctgggctgaacgtgcctgtcgctatctgtgtcagtacctgatgtaactcaggatcctcgtcgtaatatttccgtgggttatagccactcttacgcaatgcttcaacctgctcagtcgtattcccgaagataaagatattctcttcaccgacatgctcgcggatctccacattggcaccgtctaatgtaccaatggttagcgctccgtttagcgcaaacttcatattactggtccccgacgcttctgtacccgccaacgagatctgttcggacaagtcggccgccggaatgatcaactgcgccaagctcacactgtagttaggaataaagaccactttcaataaattattgatccgtggatcgttgttgataaccttcgctacgtcgttgatcaggtgaataatttgcttggcattataataagctgaggcggctttaccggcaaaaatcaccacccgaggcacccagttattgtcaggcgcgtcaataatgcggttataacgcgttatcacatgtagcacattcagcaattgccgcttgtactcgtgaatacgtttgatttgtacgtcaaacaacgctgccggattgaccacgatattgagtttttcagcgatgtaaaccgccagccgttttttgttttccagcttggccttttgtaaggccagtaagaaactggggtaatcaaggttcttttccagttcgctaagttggctcaggtcagtacgccaggtctggccaatactgtcatccagcactgccgccaagggccggttggctaaccccaaccagcgccgtggtgtcacgccgttggttttattgcagaaacggttagggaaaatacgagcaaaatcagcaaacaacgattgcaccatcagctcagaatgtaacgcagaaacgccgttcactttgtggctggcaatcaccgccagccaggccattcgtatccgtcggccgttgttttcgtcaataaccgatacccttgagagcagctctttatcgtcaggatattgttcctccaccagcttgaggaaatgctcattgatatcaaagatgatttgcagatggcgtggcaaaatcttaccgatcatatcgacaggccaggtctccagcgcctcactcatcaacgtatggttggtgtaggaaaacacttgttgcaccacatcccatgcgtccatccaggtaaatttatgctcgtcgatcagtagacgcatcatttcaggaatggaaagcaccgggtgtgtatcattcagatgaatagcaattttatcggctaagttattgaatgtatgatgcatcgcccaatggcggttcagaatatcctgcactgtcgctgagactaaaaagtactcttgtcgcaagcgtaattcacgcccggaataggtggaatcatcggggtataggactcgagagacgttctctgaatggtttttatcttcaactgcggcaaagtaatcgccttgattaaatttgcccagattaatttcattactggcctgcgcagaccataagcgcaatgtattggtggcatcagtatcaaaaccaggaataatttgatcataggcacacgcgaggatttcttcggtttctaaccagcgaatcttgctgccttcttgctgaatacggccaccgaaccggactttatagcgggtgttgtgccgtggaaactcccatgcattgccatattccaaccagttatctggcgactccatctgttggccgttaacaattttctggctgaacatgccatattcataacgaatgccgtaaccccgccctggtagcgcgagggtggccaatgaatcgaggaaacacgctgccagacggcctaaaccaccattacctaaaccgggatcgttctcctctttcaacaactctgacaaactgaggcccatttcatccaacgcctgctcgatctcatcataaatccccattgataacagcgcgttagataatgttctgcccagtaaaaactccatcgatagataataaacctgccgaacgtcctgtgataattgagcgcgattagaacgtaaccaacgttcaaccatgcgatcacgtaccgcaaatagagttgcattcaaccaatcatgttgcgtcgcaatggtgggatctttgccaataataaacattagcttataggcaatagagtgtttcagtgcatccacactgacaacgggtgaggtatagctaaacggtgatgtcataacgtttttcccaagtttaatggctacaacgagtcgacaatgacgagcgccaacaataacgagcgctaacaattaccagtttcaacgattaccagctccaacgattaccagttccaacaattaccagctccaacgattaccagttccaacgattaccagttccaacgattaccagttccaacgattaccagctccaacaattatcagtttcaacaattacagacgtcgataaagtgacaaataatctacggcggcaagttgccaaccaaagtcgagcctcatcgcatggcgctggacgtgacgccaatgcttcggcctgctccacagtacaaaggcacggcgtatcgccttcactaaggcttgcgcctcacattcattgaatacaaatcccgaagcgctgccgtcagccaggttttccaacgcgcaatccaccacggtatcagccagcccaccggtatgtcgcaccagcggcaacgtgccatatttcaacccatacaactgtgttagcccacagggttcaaagcggctgggcaccagaatgacatccgacccggcaataattcgatgagagaatgcctcgtgataacctatttgcaccccaacctggccagaatgctctgctgcggcggctagaaatgcctcttgcagcgtggcatctccgctccccaagacgaccaactgcccccccagtgccagtaattcgggcagtgcttccaataccagatccaaccctttctggacggtcaatcgactgacaacagcaaaaatgggtttattttctgccagttgcaaacccatagccgtttgcaaatgtgttttattgatggcctttgcttgcaggttctccgcatcataacgagtaggtagcaaggtatcgctctgcggatcccaaatatcactgtcgaccccgttcaggatccccgtcaaccggccttgacgcgccaacgcttgtagcaacccctccatgccatagccaaaagcaggctgagtgatctcttttgcataggtcgggctgacggtcgtgacatggtcggcaaagaacaacccggctttcagataagagatctgcccgtaaaactccagcccatagatctggaaaaactcagcgggcaggtgtaattcagataagtgatcggcagaaaatagcccctgataagccaaattatggacggtaaacaccgatcgtgcaggccgcccacgcgcagccagataagcacaggttaatcccgcgtgccaatcatgggcatggacaacctctggacgccagtaaccgtccaggccacaagccagttcgcacgccatccatcccagcaaggcaaagcgtagatagttatcgctataggcatataaagaagcatcgtgataagggctacccgcacgatcatagagcgctggcgcatcaatcagataaatgccaatcccccgataatggccatagcgtaatgctacccgccccgcaaaagtgtcaatctccctgaccagtacggtctcagggatccctctacgcaaatccgggaaggcgggcaagatgatccgcacatcagccccctcggcaagctgagctgcgggtaaagcaccgataacatcagccaacccgcctgtttttagtaaagggaacagctcagaacatacatgtaaaaccctcatcatcactcctgctcttttatacccttctgacctgaagttgcagtggtgttagctgctttccttcaccctaatgactggcctgtatcgacgccaatttgaaaaacaaagttaatattatcaataggttcattctgataaataagttcagtctgatcaataagctcagtctgatcaataaatccaacctgacaaataaaaaacctaatggctctattttgcctctaactttgccagcatatcccgagtcactaacaccacccccccctctgaacggtagaaacgggcgctgtcttcattcgcgttttcgccaatcaccattccctcaggaatgtgacaggcacggtcaataatacagcgacgcaagcgacaagatcgccccacatggacatcaggtaacagcagtgaggaatcgatagtacagaacgaattcacccgcacccgagggaacaacaccgaatgcaccaccactgaacctgaaacaatacatccgccagagaccagtgaattcatcgtcatgccatggctaccagatcggtcttggacaaacttggcgggtggcaatggctccatatgggtgcggattggccaggcgcgatcatacatatccagctctggtgtcactgacgccaaatcgagattagcccgccagtaggcgtccaatgtcccgacatcgcgccaataaggcggtaattcagcattggaagtgacacaagagagatcaaacggatgcgcccagacgacttttcttgcggtgagttgcgggatgatgtctttaccgaaatcatggctggagcctggggtattattgtcctcttcgagtaacttaaagaggtagtcagcattgaagatatagatccccatgctagccaatgcgttgctcggatcacccggtataggaggggggttcgcgggcttttcatagaacgcggttatctgataatccgcagtaacctccatgataccaaactcactgccttcactaattggcaccgggatacaggcgacggtacattcagcccctttttccacgtggtcgagcagcatacgagaataatccatcttatagatatgatccccagccagaatgacgatatattctgcgtcatagcggcggataatatccaagttctgacagaccgcatccgcagtgcctttgtaccattgctctgtgctcaaacgctgttgggcgggcagtagatcaacaaattcgttcatttcttcattgagaaatgaccagccacgttgaatatgctgaaccaatgtatgggactgatattgtgttatcacaccaatacggcgaacccctgagttcaggcagttggagagcgcaaaatcaatgatgcggaatttgccaccaaaatggactgcgggtttggcgcgggtggcggtcaaatctttcaatcgtgagccacggcctcccgccagaatgagtgccacggttttattgggtaattgtctggccaacatcaatgagtctgtactttcaaacctcaccataaaagctccttaatctctctttatgagcacacaaatggtatgcgcggacccgcgccatgtggttaatcgctccgcatggtctgacaccccaaagggaggaatcccctcccattccccttcaggtaagtgcatttcacactcgtgatcagtggcattgatgagcaccaaccagcgctgagataacaaaatctgtagttgctgctggcagccttgctcccaagcagcatcactcagcgcctgtccctgactatccaaccattgcacattactatcgccgctctgccaccattggtcctgagtcagggctgggatttgctggcgcagccggataaggtcagcggtaaacgtcattaatgcacgatccgcactgccccaatcgagccaggtgaggatgttgttctgacaataagcattgttgttgccttgctggctgtggccctgttcgtcaccggccagtaacatcggcgttccctgcgagagtaataaggtggtcagtagcgcccgctgacaggctttacgccgttgccagatagccgcgtcagccaccaagccttcacaaccaaaattattgctatggttgttatcactgccatcacgattttcttcgccattcatttggttatgtttttggttaaaacacagcaaatccagcaaggtgaaaccatcatgggcggtaatttgattaatgctggcagagggtaagcgccctcgctgttcaaacaggcggcttgaagcagcaaaatgctgggcaaaggtaccgcgcggcacctcccctcgtagccagaaaccgcgcatggcatcgcggtactggtcattccattcgctaaagccggtggggaagttccccaattgataaccgcccagaccgatatcccaaggttctgcaatcaatttgcaggcgctgagccgctcatcggccgccaaggcggcaaataaaggcgcatgttgatcgaacgccggtgtgcggcccagtaccgtgcctaagtcaaaacgaaagccgtccacatggcagctatcgcgccaataatttaggcaatcaataacccactgtgtgacatacggatgactgaggcgcagtgcattgccgcagcccgtgatgttgtcgtattcaccatcgggggtcagccagtagtagctggcattgtcgataccacgctgacacaaggtcgggccgaagacatccaactcagcgctgtggttgaacaccacatccagaatgacttcaatgcccgcgttatgcagggctttaaccgcatcccgtagttctctcagcggtgatatgccctcgcggcccgaggcataatctggatccaccgcaaagggcgctaacacgttatagccccagtaattgctcagccccattttttgtagccggggttcatcaatatgaaattgcactggcagcaactccagtgtggtaatccccaatgttttgagatgttcaatcagagcagggtgtgccaaggcggcataggtaccgcgcagctctggcggaatatcaggatgtaattgggttaaaccacggacatgggcttcataaatcacggtattaccccaaggaatggcgggcggtttatccccctgccagtcatattcctcgtgtatcacaagacatttaggtaacgccgccgcactgtcgcggacatcgggctggctaacgccaccggtaaaacggggatcatcaccaaccttgccttctaacgcacgagttcgggggtctatcaacaacttatgtgggttaaaacggtgacctcgactggggtcgaaaggcccgctgacccggtaaccatagcgttgccccggcttgccgccgggaagatagccatgccagatgtcaccggtacgagcaggcatggctatctgccgctcttgcccctgctcatcaaacagacacaacgtcacctgctcagcatgggctgaaaatagtgtgaaattaatgcccttcccatcaaagtaggcgccagaaggtgtcggtgatccatgggttaataccgccatcctagttctcccgcagcaggtaaatcgttgccagcggtggcaaggtgagtaacaacgaatgctcgtggttgtggctcctcacatgatggctatcaatgccgccctgattacccaggttactgccgcagtaaaatgcagagtcagaattcaacacttcacggtagtgaccaccttgtggaatgcccacacggtagtgataacgtggaaccggggtgaaattactgatagcaatcagttcgtgcccctcggcatcacggcgcaggaaggcgaataccgaattttcgtggtcatcaaccaccaaccattcaaaaccagcgggttgataatcccattcatacaacggcgcatactggcgatagcaatggttaaggtcacgaaccagacgctgcacaccggaatgccagccgttttcatcgtccagcaggtgccaatccagactggtttcgaaattccactcacgcccctgcgcaaattcacagcccataaacagcagttttttaccgggatgcgcccacataaatgcgtaataagcccgtaggttggcaaatttctgccaggcatcacccggcatacgatcaagtatcgagcgcttgccgtggaccacttcatcgtgggagagcggtaagataaagttctcggtataagcgtataacataccgaacgtcatcaaattatggtggtatttgcggtgaacaggatcacattgcatgtaattcagcgtgtcatgcatccaacccatgttccatttatagttgaaacccaggccaccaatatcaggcggtaatgtcacaccaggaaagtcggttgactcctccgccatggtcacactgccggggcgttcaacgccaatggtcttattggtgtaacgcaagaaagcgatagcctccaaattttcccggccaccataatagttaggcacccactgcccttcagcacggctataatcgcggtaaatcattgaggccaccgcatcaatacgcaacgcatcgatgccaaaacgttccatccagtagaatgcattgcccgccaaatagttacggacttcgttacggccatagttatagatcagagtattccaatcctgatggtacccttcgcgcggatcagcatattcatacaacgcagtgccatcgaaggtcgataatccatgctcatcactgggaaaatggccgggaacccaatcaaggatcacgttaattcctgcctgatggaatttggcgacgaacgctttgaaatcctctggggtgccgtaacggcgggtcggtgcatataatcctagcggctgataaccccagctaccgtcaaatggatgttcgttaatcggcagcagctcgacatgggtaaaacccatatatttaacgtattcgaccagttgatccgccaattcgcggtaactcaaccagaaattattatcggtatgccgacgccacgaaccgagatgcacttcatagatagacaccggggaacataaatcattggctttttgccgtgcggcgctactcttcactacatcgggtagcgggctaatcaatgaggcggtttctggccgcatctgcgcttcaaaagcgtaagggtcagctttcagacgcacctggccatggcaatcaatgatctcaaacttatacaactgccccgcctctattcctggcagaaatagctcccaaatgccattttcacgccgtaagcgcatcggatgacggcggccatcccaaaagttaaaatcccccaccacggatacccgctgagcattcggtgcccaaaccgcaaaactgacaccggatacaccatcaaggctcattaaatgcgcccccaaacgttcataagggcgtaaatgggtaccttcagccaataaccagctatcaatatcctgtaataagggaccgaaacggtaaggatcttcgatgatttgtgggctctcttgccaggtaacggcaaattggtagcgaaaggatttcttacgccgagttagttgtgcaataaaaaaaccacggggatcttcgagcgttaattgtgctatccgccgcccgttctctgtctccactagccagacttctcgggcatctggcagcaatgcacaaatctgcaacccctgcgaggtttcatgcatacccaaaatggagaagggatcgccataatggccggaaataagctgattaatcacctgacgatcgggaagtactgacatactctcttcctttgattaatagcatgactgataccgatccatggaccataaagtccaaactcggcctttcagtcatgcaatccgtttgatgtataacgcgtggctaaggtcaatacatggatttaaggcctgagcccgtttttatcgccgtaaagcccagccaccacatttttttaacccatactataagcatagtcaaagggggctaaaaaatcggcttagggttcatgaagttttttcccataccaacaaatcgagaaatagagcctgaacgacggaggaaaaaccgaagtgacgtaacggctgttatgggaaggaaaagtcgcgctaaccgccagatgaaaaacctaaaataagtggcgggtacggtattggattagagcgggcttttttattaaaaagggcggtgattaacgtctctggcgcaaaatatggatacaatagcagcagaaataacgctacccagaatcactccctcccaacgtcataacagtggtcatccaacatgggcattagccaaacagaactgatcttttcccttttacaacagatgtgtgtgtatttggttattgcctatctgctgagtaaaacaccgctttttatccccttgatgcaagtcactatcaggttgccccataaactggtgtgctacctcaccttctccatgttttgcattatgggtacctattttggtctgaacattgatgactctatcgcgaatactcgcgctatcggtgcagtcttggggggaatgttaggggggccatcggttggttttttggtagggctaaccggaggcctgcatcgttattcaatgggggggatgactgcaaccgcctgtatgttatcaaccattgctgaagggctattgggtggccttctccacctttatctgacacgtaaaaaccgcctcgatttactgtttcagccgctggtggtcgcgggtattacactggtagccgaagtgctacaaatgatgattattctggccgtcgcccgccccttcaatgaagctgtcgaattggttgaaaatattgccttgccgatgatgatcaccaataccattggtgccgccatgtttatgcgtatcttattagaccgccgggccattttcgaaaaatacaccacggcattttccgcgaaggcgctacaaattgctgcacgggcggagggtctactgcgccatggctttgaccagcaaaacagtatgcgagtggcgcgtatcttgtatgaagagttgggcgtgggcgcggtagccattactgatcgcgaaaaattgctggcctttatcggtagcggtgccgaccaccatcaggtgggcagtgctatcacctccgaccatactcaccgcgcgattgaactcaatcaggtggtgtatgccgacggcaatgccgtgccttatacctgctcaatttcacccacctgtaagttgggttcaacactggttatccctttgcgaggtgaagagcaccgggtgatcggcagtatcaaattgtatgagccaaaaagtaaattattctccagcattaaccgcaccttaggagagggtattgcgcacttattatcagcacagattttggcgggagaattcgaacaacaaaaacaattactggcgcaatctgaaatcaaactgctccatgcacaggtcaacccacatttcttgtttaatgcgctcaataccctatcagtggtgatccgccgtaatccagatcatgcccgcaatttggtgctttctttatcaacctttttccgtaaaaacctaaaacgcagccacgatgtggtcacgttaagtgatgagattgaacatgtgaatgcgtatcttgaaatagaaaaggcacgctttgctgatcgtctgactgtcacggtctcactgccgaatgaactgatggaggcacgcttacccgcgttctccctgcaacccgtggtagaaaatgcaatcaagcatggtatctcacagatgttcagtaacgggcgggtcacgttgcgcggcaaattggatgacaacacgttggtattggaagtcgaagataacgccggtttatatcagccgcagccggatggcgatggtctgggaatgagtttggttgatcggcgaattaaagcgcgctctggcaatgaatatggcatcaccgtcgtcagtgaagcggaagtctttacccgcattattattaagctaccgtttattaccgtgagtgagtattaaaacggattcatttcgagagacgatcagaaaactctataaaaagtaatgccagagtataacccacctctggcattactattattcctgacacaacaccattgtttacacaacactatcgcttacacaacactatcgcttacacaacactatcgcttacacaacgctatcccttacacgacatcatcccccacgccatgttatccccttcaaactagattgggcgggtacacatcacatgaatcatggccataggatcacccatcgtcgtcagcatgccatgtgacagagaaacagccagaccgtcagtggcgttataattatcactgagccagaagaactcggcaggctcccagcccggtacattatagttattgaagtcaccccattctgaccacaagttacccatagcccgcgttcccatcccccagacaatcgcattggtgacctgactggagcttaccgtcgtgtagcctgcattcgcacaatacgttgctgcgtcagcgcgatttaacgcaacgccattattattgataaaccactggttgactctaaagctatacgagagtggactaccgccgcctttcggggtggcagagatggtgattgccggtgtacccgtcgggaataccgcattaaatgtcaccacaccttcaccgctgaccgataccagtgctggggcactgctgctccagtcatagaggctattatctcctcccgaattgaccttaaaggcagcccccacaaaaccggtggttgggaacccagcatccccgtcaaacgttgtatcaccgacggttacatccagattcttcatagcaataaaggtggtctctgttgtcgccgtcaaggtctctatcgtcgccgtgaccgtgctaaccccggcggctccattagttaaggtagccaagacaataccgttggcattgcttaccccaccatcggtggcggtgatcgtcgccccattgcttgccgcaaaggcgaccacttccccaacgattgggttcccggtagcatctttaagggtcgcctgtaccgtattggtagcactgttatccgcaaaagcattatcgaccattgtcaccagtgtcagtgtcgccagcggcccagcagtaaagaccgtgtctactgtcagcgacgtccccgttgtaccctgtttggccgtcacaactgtcacgccaaccaaactgttggtcagcgtattgacggcatccccgttatcatcagtcagtactgtcacatgactcagttgcgcaccatggttagcggtaaatgtcaccgctatatcagccactgggttgcccaacccatcgacaacatgcgcccggacctggttacgtgcaacaccatctgccagtgcattgttatcaacgaccatcaaggtggacaattgagcggtatttttgttcgcgataaacaatagattcgccgtactggcagcattattcgacactaaagttcctgtgacgtcggtcatcccagcctgggtattcgagaccagtaaggattggccgcccagcgcgttactgaacgcctcatcaacgctcaaaatagccccgttggtggcactgaacattatcctttgcccctcaattgggttctggttggcatccacgacctgcactaacacggggtataccgccactccatcagcaatgattggagtaccacttaaagggaaaagtttgattgttgccgtgctcacatccgcgataaagtacggcgtcagcgtgtgcaccatcgggccagaccgcaagattcgcgctaaaatcccgctctctccagctttagtatgggtcagcttcgcgctagcccacccatcgacgccagtaataccgctggtggtgatggtcgcgtcattttgtgatgagaaaataacgctgtagccagcaatagcattcccctgattgtcagtcaccctagcgcggacttcattggcgtccacgctattggccacggcaccatcatcgataatgacaaagtcaccgttggcaatacgggcggtatttatatcggcaataaattgaggcgtaaccgtcaggctctcagtccctcctggcgtcaccagcgttaccgtaacgtcacttggtcctgagagagtgtttgtcagtacaccgatagccagcccattggtatcagtgatggctgatgcattgattgacgcaccattagtggcagtaaagttaacttcgaccccagaaaccttgttgtcattggcatccaagagttgcagtaacactctgttttctgtaaccccattcgctaccgcattatcatgagtgatcaaaaagagatccgctctcaatgtgaccgtatccttatcggcgataaaggtcgtcgtggttgaggccgacacaccatctgcagttacagagaccttagtcacgccagtattaatattgctaaccgtgacataagcactacccaaggcatcggtctgcacatcgttctgcactaattggccaccattatctgcgctgaacaccacgttactattcggcaccaggttatcagagacatcatagaccctggcttcaactctgttagtttggatgccatcggccaccgccccatcattcaacctgaatagctcaattcgggcaccggcaccagcaacaaaccggacatcctcggtgagacccaccaagtcagtagcgaccgttgcagtcaccgcactggtaaccggcgcgttatgccttaaggtattttctgcatacccctgagcattcgttgtgaccatgttcgcggccaacgtcacattctccgtggcactaaagttcacattcattcccgtaatcacgttgccatgagcatcctgaatatgtgcctgcacgatatttctatcgctattgttggcaagcgaatcatttttctcaacggtcaacgccgacacatgggcagtggttctgtctgcaataaagacggcgtctttagcttggcttatccccatcgttacgatcgtcgcagtcaccttactgatacccgctatcgtatgtgtaaaggttgtgctgagcatcccactgctatccgtactccctaatgttggtgtcagtgttgcgccattctccgaggtataactcaccaacatactcggcaccgggttaccataagcatcagtaacaatcacacgagcggcattagtatcaaccccatcagctagcgcattgctccgggtaatggtcaggtctgaggccctaatggtcgcggtggttctatccgcaataaaggtcgtatctttgctctgcacctggttaccaacccttgcagtcaccacactggtacccgccaaagtatgggttaaggtggctttggtcagaccatctccatcactgatgccatttactgtcgtgatagcggcaccgttgccagaggtgaaaataaccgtctgacccgataacacgttgcccttcgcatcggtgacccgcgcacggacctcatttttctccgagttattggcgaccgcattatcaacaatgaccatcaaatcactttcggcaatgtgtgccgtcgtcacatcggcaataaaggtggtatcaacgttttggctactgcgactggatacgacggtcgcagtcacattggtaatacccgccagggtattagtgaatgtcaccataacgccaccttcaactgaagtctcctccagcttatattgaatagtgccagtattactcagcacgaattcaacaagttgaccctgaatagggttgccatagctatcagtgactcttgcctgaaccgcgttaaccgcctgcccattagcaacttgatcgttaacgatgatgaacatgtcactcgcaataatctgtgcagtcgaaacatcagcgataaaggtggcattaatcgttttactcacctgatcgatccgcgcattgatcgggaggctccctgccagggtatgcgtcaaggtcgccgtcgccgtaccatcgctgcctgtcgttaccgagtttggtgtaatgttcatgccactgttagaagtgaggttgaccaccgcgccgttgatcgcgttaccgtctgcatccgtcactaacacctggacttcgttggtatcgatattgttagccacggcattatctttcgtcatcgtcagttcaatcgatgccgcttttcccgccacaaaatgcatctcgagggtttcagtttgcccggtcgagtcgagcgtggccgtcactgttgtcatacctgcaagcgtattgttgaatctcatcaagacaatcccagaggcgctactggcatcgccccgagactcaatgactgcaccgttatcgagagcaaagctaacagattgattagctaatgggttgtcataagcatcggtaaccaacgcttgtgcaatgttaccggctttaccattcgcaagctggttatccaagaacgacgttagcttaagctgggctgtcgaagcatcggcaacaaaggttactctggtatagccttgatgagcgccacttattgcaaacaccgtattactgctccctgccacagtatgcgtagcgctcaccctaacacggccatcaatattggtcgtcactgttgatgaacccacaatggacgcaccattggtaccaaacattaggctttgattcgccacgccattaccgaaacggtcagtcacaaaggcttcgacaatattggtatctgcgccatttgccagtgcattattgttaataatactgacgacgatattctccagctcaccggccacaaaggcggtatcgatattggcattaaccgtatcaatggtggcgaccacattgctcacaccggactgggtatgggtcagcgtggtactggcgatcccatcggcaccggtattcacagtcgaggaaagaatagttgccccattggccgagctaaagaccactgcggcaccggtgatcgcattgccgttaacatcctgtaccaatgcgtccacctgattggtgtctgcaccgtccgcggttgcatcattaactggcacgctcagcgtaatggtcgcgactgcaccggccacaaaggtggtatcgatattggcgttaaccgtatcaatggtggcgaccacattgctcacaccggactgtgtatgggtcaggagcgttgatgccacgccatttgcaccggtgttcatggtcgggacgataatcgttgccccgttggccgagctaaagaccaccgcagcaccggtgatcgcattgccgtttgcatcctgtaccaatgcgtccacctgattggtatctgcaccgtctgcggttgcatcattaaccagcacactcagcgtgatggtcgcgaccgcaccggccacaaaggtggtgtcgatattggcgttaaccgtatcaatggtggcgaccacattgctggtccccgccacggtattggtcagggtcgccgtggcgatcccgtctgcaccggtggtgccgatcaccgtggtaatttgggctgtggcattggcagaactgaagactacagccgcaccgttgaccgggttgccgccgctgtcgctgaccaccgcctgcacgctgttgctgtttgccccatccgccaccgcgccgttaaccggcgtcgtcagtgtgatggtggcgaccgcaccgggcacaaaggtcgtgtcgatattgttggtaatgctgcctatggtggcgaccacattactggtcccggccacggtattggtcagggtcgccgtggcgatcccgtccgcaccggtggtgccgatcaccgtggtaatttgggctgtggcgttggcagaactgaagactacagccgcaccggcgaccgcattgccgccgctgtcgctgaccaccgcctgcacgctgttgctgtctgccccatccgccaccgcgccgtcaaccggcgtcgtcagtgtaatggtcgcgactgcaccgggcacaaaggtggtgtcgatattggcgttaaccgtatcaatggtggcgaccacattgctggtcccggccacggtattggtcagggtcgccgtggcgatcccgtccgcaccggtggtgccgatcactgtggtaatttgggctgtagcgttggcagaactgaagactacagccgcaccgttgaccgggttgccgccgctgtcggtaaccaccgcctgcacgctgttgctgtccgcaccattggccaccgcgccgttaaccggcgtcgtcagcgtaatggtcgcgaccgcaccggctacaaaggtggtgtcgatattggcgttaaccgtatcaatggtggcgatcacattgctcacaccggactgggtatgggtcaggagcgttgatgccactccatttacaccggtgttcatggtcgaggaaagaatagttgccccattggctgaactaaagaccacggccgcaccggtgatcgcattgccattagcatcctgtaccaatgcgtccacctgattggtgtctgcaccgtccgcagttgcatcattaactggcacgctcagtgtaatggtggcgaccgcaccggctacaaaggtggtgtcgatattggcgttaaccgtatcaatggtggcgatcacattactggtccccgccatggtatgggtcaggagtgttgatgccactccatttacaccggtgttcatggtcgggacgataatatctgccccattggtcgaactaaagactactgcggcaccggtgatcgcattgccgttagcatcctgtaccaatgcgtccacctgattggtatctacaccgtccgcagttgcatcattaactggcacgctcagcgtaatggtcgcaaccgcaccggccacaaaggtggtgtcgatattggcattaaccgtatcaatggtggcgaccacattgctggtcccggccacggtattggtcagggtcgccgtggcgatcccgtccgcaccggtggtgccgatcactgtggtaatttgggctgtggcattggcagaactgaagactacagccgcaccggtgaccgggttgccgccgctgtcggtaaccaccgcctgcacgctgttgctgtccgtgccatccgccaccgcgccgtcaaccggcgtcgtcagtgtgatggtcgcgaccgcaccggccacaaaggcggtgtcgatattgttggtaatgctaccgatggtggcgaccacattgctggtcccggccacggtattggtcagggtcgccgtggcgatcccgtctgcaccggtggtgccgatcactgtggtaatttgggctgtggcattggcagaactgaagactaccgtcgcaccggtaaccgggttgcccccgctgtcgctgaccaccgcctgcacgctgttgctgtccgtgccattggccaccgcgccgttaaccggcgtcgtcagcgtaatggtcgcgactgcaccggccacaaaggcggtgtcgatattgttggtaatgctgcctatggtggcgaccacattgctggtccccgccacagtattggtcagggtcgccgtggcgatcccgtctgcaccggtggtgccgatcactgtggtaatttgggctgtggcgttggcagaactgaagaccacggccgcaccagtgaccgcattgccctcgctgtcgctgaccaccgcctgcacactgttgctgtccgcaccatccgccaccgcgccgttaaccggcgtcgtcagtgtgatggtcgcaactgcacccgccacaaaggtggtgtcgatattggcgttaaccgtatcaatggtggcgatcacattactggtccccgccatggtatgggtcaggagtgttgatgccactccatttacaccggtgttcatggtcggggcaataatatctgccccattggctgaactaaagaccaccgcagcaccggtgatcgcattgccattagcatcctgtaccaatgcgtccacctgattggtatctgcaccgtccgcggttgcatcgttaaccaacacactcagtgtaatggtggcgactgcaccgggcacaaaggtcgtgtcgatattggcgttaaccgtatcaatggtggcgaccacattgctggtcccggccacggtattggtcagggtcgccgtggcgatcccgtccgcaccggtggtgccgatcaccgtggtaatttgtgctgtggcgttggcagaactgaagactacagccgcaccggcaaccgcattgccctcgctgtcactgaccaccgcctgcacgctgttgctgtctgccccatccgccactgcgccgttaaccggcgtcgtcagtgtgatggtggcgaccgcaccggccacaaaggtcgtgtcgatattggcattaaccgtatcaatggtggcgaccacattgctcacaccggactgggtatgggtcaggagcgttgatgccactccatttacaccggtgttcatggtcgaggaaagaatagttgccccattggctgaactaaagaccacggccgcaccggtgatcgcattgccattagcatcctgtaccaatgcgtccacctgattggtatctgcaccgtctgcggttgcatcgttaaccagcacactcagcgtaatggtcgcgactgcaccggccacaaaggtggtgtcaatattggcattaaccgtatcaacggtggcgaccacattgctggtcccggccacggtattggtcagggtcgccgtggcgatcccgtccgcaccggtggtgccaatcaccgtggtgacttgtgccgtggtattggtggagctaaagaccaccgttgcaccggcgaccacattgccgccgctatcgctgaccaccgcctgcacgctgttgctgtccgcaccattggccaccgcgccattaaccggtgtcgtcagtgtgatggtcgcgaccgcaccggccacaaaggcggtgtcgatattggcgttaaccgtatcaacggtggcgaccacattgctggtcccggccacggtattggtcagggtcgccgtggcgatcccgtctgcaccggtggtgccgatcactgtggtaatttgggctgtggcgttggcagaactgaagactacagccgcaccggcgaccgcattgccctcgctatcgctgaccaccgcctgcacgctgttgctgtccgtgccatccgccaccgcgccgtcaaccggcgtcgtcagcgtaatggccgcgaccgcaccggccacaaaggtggtgtcgatattggcgttaaccgtatcaatggtggcgaccacattgctggtccccgccacggtattggtcagggtcgccgtggcgatcccgtccgcaccggtggtgccgatcaccgtggtaatttgggctgtggcattggcagaactgaagaccacggccgcaccggtgaccgggttgccctcgctgtcgctgaccaccgcctgcacgctgttgctgtttgccccatccgccactgcgccgttaaccggcgtcgtcagcgtgatggtcgcgaccgcaccggccacaaaggcggtgtcgatattgttggtaatgctaccgatggtggcgaccacattgctggtcccggccacggtattggtcagggtcgccgtggcgatcccgtctgcaccggtggtgccgatcaccgtggtaatttgggctgtggcattggcagaactgaagactacagccgcaccggcgaccgcattgccctcgctatcgctgaccaccgcctgcacgctgttgctgtctgccccattagccaccgcgccgttaaccggcgtcgtcagtgtgatggtcgcaaccgcaccggccacaaaggccgtgtcaatattggcgctgatcgtatcaatggtggcgaccacattgctcacaccggactgggtatgggtcagcgtggtactggcgctcccatcggcaccggtattcacagtcgaggagagaatagttgccccattggccgagctaaagaccacggcggcaccggtgatcgcattgccgttaacatcctgtaccaatgcgtccacctgattggtgtctgcaccgtccgcggttgcatcattaactggcacgctcagcgtaatggtcgcgactgcaccggccacaaaggtggtgtcgatattggcgttaaccgtatcaatggtggcgaccacattgctcacaccggactgtgtatgggtcaggagcgttgatgccacgccatttgcaccggtgttcatggtcgggacgataatcgttgccccgttggccgagctaaagaccaccgcagcaccggtgatcgcattgccgtttgcatcctgtaccaatgcgtccacctgattggtatctgcaccgtctgcggttgcatcattaaccagcacactcagcgtgatggtcgcgaccgcaccggccacaaaggtggtgtcgatattggcgttaaccgtatcaatggtggcgaccacattgctggtccccgccacggtattggtcagggtcgccgtggcgatcccgtctgcaccggtggtgccgatcaccgtggtaatttgggctgtggcattggcagaactgaagactacagccgcaccgttgaccgggttgccgccgctgtcgctgaccaccgcctgcacgctgttgctgtttgccccatccgccaccgcgccgttaaccggcgtcgtcagtgtgatggtggcgaccgcaccgggcacaaaggtcgtgtcgatattgttggtaatgctgcctatggtggcgaccacattactggtcccggccacggtattggtcagggtcgccgtggcgatcccgtccgcaccggtggtgccgatcaccgtggtaatttgggctgtggcgttggcagaactgaagactacagccgcaccggcgaccgcattgccgccgctgtcgctgaccaccgcctgcacgctgttgctgtctgccccatccgccaccgcgccgtcaaccggcgtcgtcagtgtaatggtcgcgactgcaccgggcacaaaggtggtgtcgatattggcgttaaccgtatcaatggtagcgaccacattgctcacaccggactgggtatgggtcagcgtggtactggcgatcccatcggcaccggtattcacagtcgaggagagaatagttgccccattggtcgaactaaagaccacggcggcaccggtgatcgcattaccgttagcatcctgtaccaatgcgtccacctgattggtgtctgcaccgtccgcagttgcatcgttaaccagcacactcagcgtaatggccgcgaccgcaccggccacaaaggtcgtgtcgatattggcgttaaccgtatcaatggtggcgaccacattgctggtcccggccacggtattggtcagggtcgccgtggcgatcccgtccgcaccggtggtgccgatcactgtggtaatttgggctgtggcattggtggagctaaagaccaccgttgctccggtgaccgggttgccctcgctgtcgctgactaccgcctgcacgctgttgctgtccgtgccatccgccaccgcgccgttaaccggcgtcgtcagcgtaatggtcgcaaccgcaccgggcacaaaggtggtgtcgatattggcattaaccgtatcaatggtggcgaccacattgctggtccccgccacggtattggtcagggtcgccgtggcgatcccgtctgccccggtggtgccgatcaccgtagtgacctgggctgtggtattggtggagctaaagaccaccgtcgcaccggtgaccgggttgccgccgctgtcggtaaccacggcctgcacgctgttgctgtccgtgccatccgccaccgcgccgttaaccggcgtcgtcagtgtgatggtcgcaaccgcaccggccacaaaggcggtatcgatattggcattaaccgtatcaatggtagcgaccacattgctggtccccgccacggtattggtcagggtcgccgtggcgatcccgtctgcaccggtggtgccgatcactgtggtaatttgggctgtggcgttggcagaactgaagaccacggccgcaccggcgaccgcattgccctcgctatcgctgaccaccgcctgcacgctgttgctgtctgccccattagccaccgcgccattaaccggcgtcgtcagtgtgatggtcgcgaccgcaccgggcacaaaggcggtgtcgatattggcgttaaccgtatcaatggtggcgaccacattgctggtccccgccacggtattggtcagggtcgccgtggcgatcccgtccgcaccggtggtgccgatcactgtggtaatttgggctgtggcattggcagaactgaagactacagccgcaccggcgaccgcattgccctcgctgtcgctgaccaccgcctgcacgctgttgctgtttgccccatccgccaccgcgccgttaaccggcgtcgtcagcgtaatggtcgcgaccgcaccgggcacaaaggcggtgtcgatattggcgttaaccgtatcaacggtggcgaccacattgctggtcccggccacggtatgagtcaggagtgttgatgccactccatttacaccggtgttcatggtcgggacgataatatctgccccattggtcgaactaaagaccacggcggcaccggtgatcgcattgccgttagcatcctgtaccaatgcgtccacctgattggtatctacaccgtccgcagttgcatcattaactggcacgctcagcgtaatggtcgcgactgcaccggccacaaaggcggtgtcgatattgttggtaatgctaccgatggtggcgaccacattgctggtcccggccacggtattggtcagggtcgccgtggcgatcccgtccgcaccggtgatgccgatcaccgtagtgacctgggctgtggtattggtggagctaaagaccaccgtcgcaccggtgaccgggttgccgccgctgtcggtaaccacggcctgcacgctgttgctgtccgtgccatccgccaccgcgccgttaaccggcgtcgtcagcgtaatggtcgcgaccgcaccggccacaaaggtggtgtcgatattggcgttaaccgtatcaatggtggcgaccacattgctggtccccgccacggtattggtcagggtcgccgtggcgatcccgtctgcaccggtggtgccgatcactgtggtaatttgggctgtggcgttggcagaactgaagaccacggccgcaccggcgaccgcattgccctcgctatcgctgaccaccgcctgcacgctgttgctgtctgccccattagccaccgcgccattaaccggcgtcgtcagtgtgatggtcgcgaccgcaccgggcacaaaggcggtgtcgatattggcgttaaccgtatcaatggtggcgaccacattgctggtccccgccacggtattggtcagggtcgccgtggcgatcccgtccgcaccggtggtgccgatcactgtggtaatttgggctgtggcattggcagaactgaagactacagccgcaccggcgaccgcattgccctcgctgtcgctgaccaccgcctgcacgctgttgctgtttgccccatccgccaccgcgccgttaaccggcgtcgtcagcgtaatggtcgcgaccgcaccgggcacaaaggcggtgtcgatattggcgttaaccgtatcaacggtggcgaccacattgctggtcccggccacggtatgagtcaggagtgttgatgccactccatttacaccggtgttcatggtcgggacgataatatctgccccattggtcgaactaaagaccacggcggcaccggtgatcgcattgccgttagcatcctgtaccaatgcgtccacctgattggtatctacaccgtccgcagttgcatcattaactggcacgctcagcgtaatggtcgcgactgcaccggccacaaaggcggtgtcgatattgttggtaatgctaccgatggtggcgaccacattgctggtcccggccacggtattggtcagggtcgccgtggcgatcccgtctgcaccggtggtgccgatcactgtggtaatttgggctgtggcattggcagaactgaagactacagccgcaccggcgaccgcattgccctcgctgtcactgaccaccgcctgcacgctgttgctgtctgccccattggccaccgcgccgttaaccggcgtcgtcagtgtgatggtcgcgaccgcaccgggcacaaaggtcgtgtcgatattgttggtaatgctgcctatggtggcgaccacattgctggtcccggccacggtattggtcagggtcgccgtggcgatcccgtccacaccggtggtgccgatcaccgtagtgacctgggctgtggcattggtggagctgaagactaccgtcgcaccggtaaccgggttgcccccgctgtcgctgaccaccgcctgcacgctgttagtattcacaccattagccaccgcgccgttaaccggcaccgtcagggtgatggtatctactgcaccggccacaaagtgggtattgacggtctgaccaacagggtcggttaccgtcgtggctttgactgtagtggtacctatagccaggttggtgagtgtattttctgcatagccattacggtctgtcaccactggattctgtgccaaaacagcaccattcccagcatcaaatgttacagaaacacccggtactgaattaccatttgcatcaacgacccacgcacgcaccacgttggtgtcagttccatccgctttggcattgttatcaattgcggccaacgtagaaacaaccgccgtcctctgatcagcagagaacgtcattgtcatcgtcatacccaccaatgcaggagacgtcacgctaacaacggattctcctgcccgaaggttcgtgaatgtggcattaatcgtgccatctacaccggtattcggtgttgaagcaaccactatcgcgccattatctgcctgaatactcatcggcacatttggcacggcattgcctgtcccatcccgtaacacgacttggatttcattctggtcgatgccatcggcaaccgcccggtcagccaatttcatcaaactgatcgccgctgtcgacccaggtttaaatgtcgtatcaacttgttgagattggcttcccaacgttgcagtgactgccgaaacccctgcggtggtattggtcagcgtagagtcagcaatcccttcggcattggttatcactgtttgatcgatgacggttgcaccattactggcactgaatatcacggattgattagcaacagcattagtataggcatcagtaaccttcgcccgaacagcgttagtgtcactgccattagccactgaatcatttgttgtcactgtcagatttgcggcggtgatctccgccgtgctttcatcagccacaaacgtcgtattcacacttcggctactagaacccaacgtcgcgctgaccgcactcacacccgcgacggtatgcgtcagtgtggtactggcaataccattagctcccgttcttgcctctgtcgtacttaatgttgcctgagtattaaccgcaaagttgatgatctgcccgataatcggttggccgtcaccatcggttactgtggcttgtaccgtgttagccgcaataccgttagccgtcgcattatcaactgttgtcgccagatgactgatcaccatggtctctggacgcgtgacttcaatagatgtcaccgcacgatttgaggcgttcccttgggcatcataggcaaccgcacttattgtatgtgtattgcttgttctgagaatatgttgatagaaaggtaaggtaaccgacaatgaactctgagtgagtggagaggtactgccgcccgcattttctaacggtgtcgcatcccattcaatgcggctaaagccatattttgcacgtacctgtgcggtcaatgtaatggcaccgccacccgaaccactgattctgtcaggcagaaccagatgtattagctcctgctttttataatccagaacaatattattattacgttcaaccaggtcataacggctgcccgccagtgtccggttagccgccaccgctgactgatcaatctgatcattccacggttgccccatgcgataattcagttgcacattaacgctggtattgttgttgttacctttcccctcacggtgttctgcaccaatagtgaccaaaggaaccggggtgtaattaacccccaacgtcacagcatgtgggtctttctggcgatcatccttaccaaataaggcgacttcatcgccacggtatttttcatacattaacttaccgcctaattgtggataggcgggtaaataagcctcggtacggatatcgaagccatcagccggacgctcatcgtaactgctgaagtcacgagactgatgccagccggtcaaaccaaaataggtgttagcggagaatttaaggtagtcagtcgtaacttcagcacccacccccacacgccggttttttccagtaagatcattgtcaaagaaggtattagcaccgtacatccagtcaccttggtactgacgtattccggcaccaatatttactgtgttgcggctgtctttattgcgaacaccaagttgagtaaacaggagtgaactttcactgtctttgagtggtaccaataggtccagcgcgctgttatctagcttaaaatcgctatctacattcaattgtacccgcgcagtaccaaattggttcaaccactgctgagaagatgcgttaatttcatttgtcactgctgaacgcgccatattacttgcggcatcagaggtattgtcattagaaagtaacttaccggctcccatagcatttctggctaacaaatcatcaacatcttttttattattttcattaggattattgctaaagaaagatgactctttgcggggaacttcaatctcatcccctgttgtcagtgatgcgaaaggtttggaaaaggtacgataagcattcagttttttcagttcatcaaccgtaatattatatttttttgctatcgattgaatagagtcacccggccccagcgtataaggttcagtcgcacgtgcagcaggaggcaaaatagacgcattaactggcgttatgactgaggttggtgctgaattagtcgtgtttgcggcagcaattgcgggcgtaaaagagagacttagtgggaatgcaaattgaaagaaaagtgtaatccatgcgacaacttttatttttctggggtgtcctttttccttcacatcatggggacgagaagtgtgatgagacaacttccatttccaagaaatgaggatcgccctaaaataatttaacatggatacttcactcgcaaatagaaatgctattaataaaaaatcctgaacaatttaaatttctacttacactgctcagagacaatccaaattaaaataacctcacagtaacaacacaaaaaatatggccattaaaaacaaatcgttaacaacgtcaagggagatagtctaacgccctgaaacagttaacaattaatccaataaaacatgtttatcgttgttattgtcgtatttttagttaaacataaagctgtatatggtgataaggagcattattcgctatttaatggcctttataggcgaaaaatcactacatattacttcaatcttttttgaacgtttattcccaagaatagcttttctagtactactatctgaagcagacacatcaacttgcctaccaagaaaaatcttatagctcaagtttaaatagtagactgtatttttataacggtatcagataatctgcaaaaaaaatgacgcccagcacacgaatcattaacgcatgcgcaagtcttcagaagcgccacataaaatggagatatttcaatacgctgaaatttatatttatctggcatcataaacatggtgtacacgtacaattgtgtcaaacgcagacgcactagcagtaactctagtctcaagtagaaacccaccttaaactttacctgtgcattatattctaaaaaaatcctaaaattatttttaacatcttaaaaataatattttaggattaatgcccgaaaattttgatgcacaagtgagaatgacaatgatgttacgtcttaaacataatcttgtttcctcaacaatgacgactctcatattctttccctgtaggggtacctttatgtgatctatgcatctattcacattaataaaatttaatctttgtcattcaaaaagtaaaaagtcatttgttatacggcattcaattcaaaatgattatagtgataatgacacctcttattgaaaattcgcccatcgataattaaaccaacaccgtgcttttaatcgatataaataaccacacttcgataaaaaacgatatcgacacgacttatctttatgtttaatagaatagaatacaaattcctttttagtccgcaggatgtcaataaataacatcatacggataaagtctcttcggtggcgtagcagagaagcggctaggggaatggaaaataggtgtcaatatctgaacaaagatattcgcttaaaatataaaaaaccctgaccataagatcagggtgctttgttgttccttgttatcggttgtttctcgatattgttacagcagaattcgcagcatacggcgcagtggctcagcagccccccataacagttgatcaccaacggtaaaggcggacaaatattctggccccatattcagcttgcgcaagcggccaactggggtattcaatgtgccggtgaccgcagcaggtgtcagttcacgcatactcaattcacgatcattcggaataacccgtacccagtcattgtgcgtcgccagcatttgctcgatttcggctaatggaacgtcttttttcagtttcagagtaaaggcttggctatgacaacgcagcgcaccaacacgcacacataggccatcaacaggaatcagagtactggcactcagaattttattggtctcggcctggcctttccactcttcacggctctgaccattatccaacgctttgtcgatccacgggatgaggctacccgctagcggcacaccaaaattatcggtcggtaacgtgccactgcgagttgttgacgtcactttgcgttcaatatccaaaatggcagatgccgggtcttgcaactcttttgccacaccagcatgcagcatacccatttgggtcagtaattcacgcatatgacgagcgccgccgccagatgcggcctgataagtggcaaccgatgcccactccaccagattattggcaaacaaaccacccagtgacattagcatcaggctaacggtacagttaccgcctgcaaaggttttgatccccttatccagcccctgcttaatcacatcgtggttaaccgggtccagaataataatggtgtcatcttgcatacgcagcgaagaagcagcgtcaatccaatagccttgccaaccgattttacgcagcttcggataaatttggttggtatagtcgcccccttggcaggtgatgatgatatccaatgcactcaatgcatcaatatcataagcatcttgcaacgtaccttggtggcccgcgaaagccggtgcagcctggccatgttgagaggtagagaaaaagactgggcggataccgtcaaagtcgcgttcttcaatcatgcgttgcatgagcactgagccgaccataccgcgccagccgataaaaccaacgtttttcatgtttactgccctgccttggaaggtgacaccgatttatggatacctgtcttgtataactgcgcgcggttacccaatgtaagtgggagttgcggcaaggttgcaaacgcacaaatcccaatacgctgattcagctcagtgagctgggtatgtgaacgtggctaacaccactacaacgtcaagtacgaggggtatatctagcacggcagactgactaagatagacttgataccaccttacaaaatatgggcaaagtggcaagtgaatttattcgataccagaatgattcaaagaaatttttctaatatgtgactttatctggccgaaaatgccagtagcctttatccctttgaggtaatgatgactgagatgattgcggcaactgtgttgctatttttaattatggatccattgggaaatttgccgatttttatgtcggtactcaagcatttggagcctaaacggcgacgggtggtgttgatccgtgaattactgattgccttaattttgatgctgatttttctgttcgcaggcgagaagattctgttatttctgaatctgcgcaccgaaaccgtctcaatatccggcggtatcattttgttcttaatcgctattaggatgattttcccttcctccgagagcaacgttactgggctatctgctggggaagagccgtttttggtgccactggcgatccctctggtggccggcccctctattttggccaccctgatgttgctgtctcatcaatatcctaatcagctcagccatttggtgctggcattgatgattgcctggggcttatcggcagctattttactgatgtcgaatctgttcctgcgtttgttggggagtaaaggtgtcagtgcgctggagcggttgatggggttaattttggtgatgctatcgacgcagatgtttttagatggtgtgagggcgtatttggcgatttgaacgcaccattcaagagcagaccggattaggcctcggttgatattccttattgcgctcaacgtcaaaaaaaccaattcaaaatgggtctttgactgctgacaaaccccgatgatgcgatctgcctgttcactccgttacgggcactttgtcaataacctcaagcctcttctgaggcttttaataattagacgtcaaaatcatcagggtaagctgctttgagtcttttttgcttgtcttgaaaattgggatctacttggttaggtaactttacttttagcccttttctgatttgtgaagcaatataaaaagcatcacctagccgatcttcaaaaataggatctgttgcttcgaattcttttgttgcatacatgccgaatgttagtttccaaagctttgttttatctttttcctcgctggtaatcaccttgtgcagataaatcaactgctgaacgatggagttatacatgggttcaagcgtcttaccaccaatgacgttatattgaatatgatggtggcgtttctgagccagacgcagtgccctgtccacgtaatctaaagcggtgtcgttggtcatttttcggactccatacgtctttattggtactgaaccattgtatgccgccgccttcagtctggaattaatctaatcactatatacggcttaattgttctggtggtattagacgtcaaaatcatcagggaattctgacctaagcttttcctgccgttgttggtaactatcgggattttcctgatgaggaagctgaactttcaaaccaccacctatctgatcggcgatataaacagcagagcctatcctatcggcaaaaattggatccataacgtcaaactccttcgctgcatacatgcccatagtcattttatggatccggcttttatctttttcctcgccggtaatgacgttatgcagataaatcaactgctgaacgatggagttatacatgggttcaagcgtctcaccaccaatgacgttatatttaatatgatggtggcgtttctgagccagacgcagtgccctgtccacgtaatctaaagcggtgtcgttggtcattttttcgaactccatacgtctttattggtactgagccattgtatgccaccgccttccgtctggaattaatctaatcaatatatacggcttaattgttctggtggtattagacgtcaaaatcatcagggtaagctgctttgagtttcttttgttcatcataataatcaggttctatctcatgaggtaacctgactttcagaccatttcctatgtgcttggctatgaatagagcactacttatcctatcggcaaaaattggatccataacgtcaaactccttggctgcatacatgcccatagtcattttatggatccggcttttatctttttcctcgccggtaatgacgttatgcagataaatcaactgctgaacgatggagttatacatgggttcaagcgtctcaccaccaatgacgttatatttaatatgatggtggcgtttctgagccagacgcagtgccctgtccacgtaatctaaagcggtgtcgttggtcattttttcggactccatacgtctttattggtactaaaccattgtatgccaccgccttcagcctggaaaggtactttagggactgaccaggtatccaatgctgggctggcggtactgcgcaacatctgcaccggctgctgtgattgataggttgtcatcactttgggaaccttgatatcggtgccgcgcaagttcccttccgggttaataccgagtttggttggtggaatatctttatttaatgaataccaattgccttgccaattacctggagcctgattctggtaagccaacttacccttgttaatggactcaacagataccctctcgtttagattgataccatccatatattgctcaatagtacgctctttggatatcccgctttctttcatgaaattcctgacaatgtccttattacctcgaatgttgatatcgtgattgatatcaccacttcgaccaaacttgtcattaaggtaagcatgtcggtctgaaacggtattggccttctttatggtggaaggtttagataaagttgctatctgacggacagtatttaatcgtccaagaccaagacctgcggcaattgacgctcctgcaatgagtaagcctttagactcatcattcatgacctgctcaaatcctttagccgcatcaccgcctaaatctttagctgctttctcaaagccttcaacattgccgttgtaaattccgccagcggccagcagacgacccgcagccttgctgttgatcgtacggaaggcttgtggttctggtaaatccggcgctgaagcgcgtactaaacgcttaacctgtgttggtcgtggttttcctcccgaacgtcgataatctctacaactcactgacttactgtattcagtaataatccttttcgcgccatcatgatgaaaagcaagcggatcgctgcaaatcaacgtaccgtcttcattgatgtgaaagagctttgccgggccgtagaggtcactcaacatcactacctcaccggaaaacaccattctctccagcttatctttttcacgtggcccaagagaggaagcctgagtatgatgaacctgtctttcacgcatgttgataatatagtgattggcatgatagccatcattaaattcatactcacggcaaacccgtgaccaggcagcataggcgctgactatacgttcatactcttcggggcgaagattatctctggataagttgtacaaatagatgccgggaagacttaggctcatctcaactcctggcgaaatgagccgtaatataatgtttggatcagcagatatgcagcggggcaggtgtcagtggtgatattatcgtggatactcatcgttccctcagtattaacattccatttaatgtggttaacattaacacactcggaacatcgagggaaaaataagccagtatcgccattaagttaggcggctaacactgtcgtcagtatttcctgttgcagcccgtggtgaaggttaaagcccctgagtttaccccgtatagatataaaattactttatcagactgctggcaaaatccgatgacgcgaaccagatccagatcaccaactcactaagccaacgcccccacacatcgccggacaacctcatcaatatcagtatcaatatccacacaaatcacatcaggctcatccgggccgggttcttccaaggcgtcaaattggcttcttaataaatcgcttggcataaaatggccggaacgtgcttgcagccgcgccatgatgacgtcaaaattgcccttcagatataaaaataccatgccctgattgccctcgcgcaagcgatcgcggtaacaacgtttcagcgcagaacaaacaataatgcccgtttcatttttatggctcaggctgtaagccgcatcgcttaggcgttctaaccatggcatacggtccgcgtcattaagcggttgcccactccccattttctgaatattggcgcgggggtgtaaatcatcaccatcaataaatttggcatgaatctggcgcgcgacagcctccccgactgtggttttaccactacccgatacgcccatcacgataatgctctgtcccgccatatgttgatctctatctcagaatggaaattctactggtgcctatagttccgtattttatcatgttaccggtatcatgataccggtaacaaatggagatgtgacttttatcacaacagatagcgccgttatcacaatagataaaacagctatcacgacagataaaaaacactgccttcgtactcaatcacgcgagccaggaaaggccggagaaatattatgccattaatcatcgtcgcggttggcgttgccatgctgctattactgatgatccgttacaaacttaacggatttatctcgctgatactggtcgcgttagcggtaggtatcatgcaagggatgccaatcgataaagttgtcggctcgatcaaagcgggtgtcggcggaacattaggtagcctggccttgattatgggcttcggggccatgctcggtaaattgctggccgattgtggcggcgctcaacgtatcgcgaccaccttaattgagaagtttggtcaaaaacatattcaatgggctgtggtactgaccggctttactgtgggttttgccctgttttatgaagtgggttttgtgctgttattgccgctggtattcagcattgcggcctctgcccgcattcccttgctatatgtgggtgttcccatggcggcggcgctttctgtcactcatggttttctgccacctcacccaggcccgacagccattgccaccattttcagcgccgatatgggcaaaacgctgctgtacggcacattgctggcaatcccaaccgtgattttggcaggcccggtctacgctcgctttctaaaaggaattgataagcctgttcctgaagggctgtataacccgaaaatctttaccgataaagagatgccaagctttggagtcagtgtcagtacggcgctggtaccggttattttgatggcattgcgggccgtagcagagatgattttgcctaaaggccattcgctgctcccctatgccgagttctttggtgatccagtaattgctacgctgattgccgtgttaattgcaattttcacctttggtctaaaccggggccgctcagtggaatcggtcatggagaccctgtctgattccatcaagatcatcgcaatgatgctgttagttattggaggcggcggtgctttcaagcaggttttagtcgatagcggcatagagcaatatattgctggcatgatgggcaatagcggggcatcgcctattctgatggcatggtccatcgccgccttactgcgtatcgccctgggttctgcgacggtagcagcgatcaccgctgggggcattgtcgcaccgttaatcgcgaccaccggtgccagccctgagttgatggtcattgccgttggttccggtagcgtgatcttctctcacgtgaatgaccctggtttctggctattcaaggagtatttcaacctaaccattatggaaaccattaaatcgtggtcagtactggaaaccattatttcagtctgcgggttgatcggctgtttgttgctgtctctggttatttagccaacggcgcgataaatagtcgttatataaatggctgttatataaatggttattatgtaaatagttactatataaatgattgctatattttttatatactgccaccggggaggatggtaaagccgacatccaccatttggggtgttaccacttctccgcgcaacctggccaataaacgctcggcaccgatttgccccattctttccctcggtgtcagtacgctggccagtttcggtaccatcgactggccgatatcatggccatggaaaccggcaatagccatgtcatgggggatggatagcccctgacgctgacattcaaatacggcaccaatggctaaatcatcattggtacagaaaatactgtcgatttgtggataactgacctgcgcttcacgtagcagttcagcgccagcggaatatgacgatgaacggctggtcatcacgctcatcggtaccagaccggattcgcgcatcgcttgctcatagccctgctgcttgatcaccgtgcgctcatcttggcgagcgccaaaatacaccacatagcgatggcctttagcgataatttgctgtgtcatctgccgggcagcctcaaagttattaaaccccacggccagatcaaggcaaggcgaaatacaatccattagctcaataacagggatacccgcgacctcaatcattttcagggtccgcgcggtatggtggcgttcagagaggatgaggccatcaatattgtaggagagaagcgacgtcagccgctgctcttcgcgctctttctgatagccgtagtgagccagcatcgtctggtaaccgtgcgcatccgtcacactctctatcccccgcaaaacctcagcaaaaacctgattagttaacgacggcagcagcacaccaatggcatggctggtggcattggagagaatatcgggagcgcggttggggatatagcccaattcgtccaacgccagcgcgattttttcctgtaaaacagcagaaacctgttctggattccgcaaataacggctgacagtcattttagtgactcccaccatatcggcgacatcttgtagcactggcctttttttcttcattatcaatgaactgaggctggatgaacgggaggcaattctagcaaagaaaagggtatagcgcgatgtgcataccctttttagttaacgtaaaccgggggtaaatcaacttaaattggtggtaaatcaaacaacaggatctcgctgtcttcatcggcttgaatagaaagcgctgtttcatcccagatggcgaatgcatcactggcaccaccatgatggccgttgatggaaaccttgccgcgcaccacttgaatccaaacacggcgttcagcctgaatctgatacgttgactgcgctgtacgattcaatgcccagcgccagagagtcatatcctggaacaccttcaatgaaccatcacgggcatctggtgataaaaccaactgccgcccttgggggagatcaaacatccgttgctcgtaacggggttccaaacctagcttgtttggaataatccaaatttggtatagatgcagcggttgatcatcacggccattgtattctgaatggcgaatgccagtaccggcgctcataatctggaactcacctgcatggatctgttctttgttgcccatgctgtcctgatgttcaaccgtgcctgacaagacatacgtcaggatttccatatctttatgcgggtgagtaccaaaaccctgaccagcatcgataacatcttcattaatgactcgcaaagctgaaaaacccataaaatcagggtcgtaatagtctgcgaatgagaaggtatgccagctatccagccaaccgtgattagcatggccgcgatcgtctgctttacgtaaaaaaatcatattcagttctcctcaatgttttctttagtctagaggtagtccgagaatatgaaagcgtaaaaaactcacccctctgttcaaaaaattcgactaactcatcacgggaaaaccgcgaggtgagtgaggagctataaagggtgccattcagcgggaagattattacggcagaaaccgtgacagaggcaagctagcagagaacggggtgagaaaaaggcaaaaaaaagccagcacccggctggctaagtaaacactggaagcaatgtgagcaatgtcgtgctttcataatgtgaacacctaaacttttgatgcgctcatctgaaagcacggcaatgataatcattatcactctcacttgtaaagcgtttttttaaccaaatacaatattattgattcaggtaaagaaaacgatattttaataacagattcaaacactaagagtaaggttatgtggtgagagagaacctgtcctgggatcgggaatgctgccgcgcggttgctgcgcctcaccaccaggatgcacctgattcacctgagaagtcattcgctatcgtttcctatagcgtcgcttccatctgcacgtgaccccaatgaattccgtaagcatacgcagcacgggaaattgctcatcatcaacattgatgtgtcgagtaagctgacgtttgtgacagcagttgaaaattcaacacagctcggtgtcatttatacggctggcaatcaacaatcggatacacttgtcaacacccctcacctctggaaaaaataatgaaacctgcaatcctcgtggtggatgacgatacggccatctgtgaagtgctgcgagatgtacttaacgaacacgtattcgatgtactgttatgccacagcggcaatgaggcgcttcagattaccgctacacagccctcaatcgcacttattttgcttgatatgatgctgccggatatcaatggcctgttggtgttgcagcaagtgcaaaaactgcgcccgtcgctaccggtcgtgatgctcaccggcatgggtagtgagtctgatatggtggttgggctagaaatgggggcggacgactatatcgctaaaccatttaatgccagggtagtggtcgcacgcgttaaagcggtgttgcggcggagcgaggtgttggcgatagaaagtagcagtgtgaaagcctgcggattgcaatttaatggctggcggctgaataccgaccgctgtcagttgatgaacccacagcagcagcaaatcgatttgactcagggggaatatggcctgctgctgtcgttgatgcaaaacgccagaaaagtgctctctcgtgaaaagctgcttgaactgacgcaccgtgaaagcctggacgtttttgatcgcactattgatgtactgattatgcggttacgtcgaaaaatagaagttaatccgcaccagcccacactgatccgtaccatccgcggcgtggggtatgtctttgccgccgatattattcatgcctagaataatgtggcctaataagatggggcttaagacgctctccccatcgggctatcttatgcgcggtaatggcttatttaacggttctcacgaataaacacgtctaattccgccagtggctttgcaccatcaatagcattggcacaaagtaaattggcacgggcgcaggcgtgggctaattgaatacaatcagttaacggccagcgttcatggtagccatataatatgccagcgcaaaaggcatccccggcaccaacgctaccgactatctcttcctgggccagtttccacgaaggcacccatgctccctcctgcccatgctctacgccccatgcaccttccgggcagtgaatcaccacccgctggcgcacgccggcttcaagtaattgttttgccgcctgagcgatatgatggacgtccggggtgccatcggcaagacgcatctccagcccgcttaactcgccagcctccagttcattaatggtcagataatccagccagcacaacgttggcgtcaccagtaaatgataacgaggatcgccttctcttgacactaagtcgagggaggtttcataaccaagctgcgacatcagcgccagtagtctggcgctacgagtaccgtactcggtgtcttccacatccaaactatcgagcaacagcagatagccaagatggaaaattttaaatgatgtatcaaggccatcgaaagcgggcaagtcgagcaggcggttggtgcctggagagtggaaaaaggtgcgctggccgctcggatcggtcatgacttgtgacatagatgttggagccaaggtggtccgccgaacgtgttggcgattgacctgatactggtcgagcatcgccataatgtaatcaccgtcatgatcatcgccaataaggcccaccgcctgcagcggcagcccggtatacattttggccagcgtcagcaatacgttaagcggtgcgccgccggttgagcgctcgctgtgtacgatttccgccagccaaccacgctgcggccattgctcaatttgatgaacatggtcgaccaacatattaccggcggcaataatcccgttgcgttctatcatggcatcctctcagatttgctctgaactgccgaaaattcgcatttgttgcgctacgacatcagtaatagcctcctcgatccccaggaacaactcggcgaactcgtcataaatagcgtgtcgatgagtcattttctgttccacggcagccagcgctgcctgcgacatgccggtataaaaattgattttatgaatgccaaggctgatagcccgccggaaatcggtatcgctgatcccagagccaccgtgcagtaccagaggtaggccggtttgctgatgaatggcggccagacgcgcgaagtcgagcttgggttcacctttatacttgccgtgtgcgttgccgatggcgaccgctaaggcatcgataccggtacggtcaacaaagtcccgggcgatagcgggatcagtgaatttattgctatcagcttcaccataaagcgcgccgccttcatcaccgccaacagcgcccagttcagcttctaccgatacacccacggcatggcacatcttcacaacttcacgggtttggcgaacgttttcttcatattcaagcgtggaaccatcaaacattaccgagctaaaacccagcctgagtgcgcgaaccacggcttcaaagtgcaggccgtggtcgagattaagcaccaccgggatatcatggtgtgcagcttcgaatttcactgcttctaccaatgattctagcgaaaggtacttaaaatggacttcagcaatattgatgataaacggcgatcgttcctgttttgcagcggcaaacagggcgcgcaaaaagtggctatcgagcacgttaaaggcacccaatgcgtaaccgtttttcctggcatgagccaggccatttgcaagggaaatcaaagccatagtcgttctcctggtgttggcaaattcagacgaaacggcagtactcattacacagcacaaattcagccggttcgtcttcaataatcgaattaaaacgttcaagaggtttcataaatcggttgtcgtggtcatcgtcatttaccatcgatacctcaccgaccagcacctcaccgtaacctacctcgccccagaaactgtggtacaccccaggcaccaggcaaatactttcaccgggagataagcgtaactggctgcctgccgcatgggtttggcggcagccgtcgagtgtcacggtgacatcgctcttctccgtttgttcaaacgcgtcggaattccatagctcgacgataagattgccgccgccacggttgatgatatcttcctgtttacgccagtgaaaatgcataggtgtcacctggccttcgcggacgtgcatgattttttcggcgtagcatttagggtaaggagtgccgcttaccgaaccgttgcgtaaggtgaacagcgttaatccctgagtaaaaaaatggttcccgccgaatgcggtaatatcccagccgagtttcaggtcaaacagttcttgccaggctttagggtcaagctgttgccatctttgtggcgtgaaacgggcaaatggcggtagctggatatggtgtcgggcaaagaaatgaccggtctgcttaaggatttggttgacctcggagcgtttcataaaatctcctcaaaaagttgcccctctccttaatagggagagaggattagaccgagccgaagtgaggcgagctgttatttcatcgtccagcctttgtaagtgctgatattatttttgtcgatcagggtcactggtatcaaaataggatcttttggtgctgggttgccctgcaagatgccataaccaacctcaacggctttggaggccatgacctgaggatcttgcgctggggtcgcgacaaacaatgtgttaccaccccgtttcagcgcttcttctgcatccgggctgccgtccacgccaacaataaagaattcattacgttgtgcctgtttggcagccaaatcagccccaatcgccgttggatcattgatggcaaacacgccatcgatcttcgggttcactgccagcaaggaggtcatcacctccaggccaccttctcgactgcccttagcattttggttagaagaaaggaccttgatatcaggatattttttgaattcgctttcacaaccttcaacacggttttgtatggcagacactggcggcccgttgataataaccacgttgcctttctctttcagacggtcggatatgtacttacacgccatcgcaccggcctgagtgttgtcagaggtaatcgtggcgtcagccccttctgctgccacatccactgccaccacgacaataccggcatctttagcacgcttcaccgccggaccgatccctttagaatccgcggcattgagaatgatcatgtccactttggcggcaataaagttatctatctgtgccacctgctggccgagatcgtagccgctggaaacgagcgtaactttgactttatcgccggccaacttacgcgcttctaactccacacctttggtgatttgcacgaaaaatgggttggcaagatcgcccaccgttacgcctatcgagttcaactctttcgcctggagcgccggtgaactggctatcatggcccccgcgattagtgcggtcattatgggtttcaaacgcatgctgttactcctgtgtaagggtatttttagttatgagttatggtgacgggtacggtatttgtctatcagcaccgctatgatgatcaccgcccctttgatcaccaattgccagaaataagagacccccattagcgtcatgccgttattgagggtggcgataatcagagcaccaaccagcgtgcctgtgatggtgcctactccaccaacaaaactggtccccccgaggataaccgccgcgatggcgtccaattcatagcccataccaagattgccgttagcgctgtaaagtcgcgatgcactcatgacgccgccgagtccggacagcaacccgctcatgccatagacaaacagcagcaccatccacactttaatgccggtcaagcgcgccgcctgcatattgccgcccaccgcatatatgtgaacgccaagggtagtgcggcgtaaaataaaccagcacacggcaaccaccagtagggcgataaccaccagccacgggaccgggccgagataagcattgcctatccactcaaaattaatgttcgagttgataatagtggtgccatcagccagtaagtaggccacaccacgcagcgccgtgtatgtgccgagggtaacaataaatggcggcagtccagcccatgccaccaacatgccgttaaacagcccaagaccggtacccattaatagcgccgccggaatagaaagaccttcccagccgggcatcagcgaaactgccatggcggtaactgccgtagtcccgagaattgaccccacggaaaggtcgatacctccggtcagaataatgaaggtcattcccgccgcgaggacgatatttatggatgactgccgggcgatattaagtaggttagattcggtaaagaaatttggggcgagaaacccgaataccgccacaatcaacaccagaatcggtaaaatacccacggtttgcagtaaatcgctaaaaaacgcttttttcagcgaggcagattttgccacctgctgcggcgtgcctgagttagtcatggtaaacctcttttttatggtcctcggtcacgccagttgccagcgtcataatattttcctgcgtgatatcagggtgatgtagttcccctgcaatacgtccttcatgcatcacgtacacccggtcgctcatccctaccacttcgggcaactcactggaaatcatcaaaatcgccaccccctcgcgcgccatctggctcatgatgcggtaaatctcgcttttagcgccgacgtccactccacgtgttggctcatcaaggataagaatgcgtgggctaatcgctacccaacgggaaatcagcagcttttgctggttacccccggacaagcctccggcacgcacctgcgcatgaggtacacgtatgttcaaccgattgatggcgtcgtctgaaatagcacgggcttttttgcgatcgagcaggccgtaacaggcgtcccgctccagggttgccatagtgatgttgtcctgcgcggccagttccaaaaacagcccttgctctttgcggttctcggtcagaaaaccaataccgtggcgaatggcttcacgaggggagtgaatgaccaacggtacgccatctatctctatcgttcctccggtggctttgcggacaccaaaaatcagttgcgccagctccgaacgccctgcgcccaccaaccccgctaacccaacgatttcaccggaacggacctgtaaactcaccgcctgcactttggcaccatccgtcaggtgatgaacattaaggcgtaaatgaccgagtggaatatcccgttctttattgaacagatcgctaagcggacgccccaccatcatgcgcaccagttcgttggcgttgaggttggcgcgcatcaggctgccgacgtattgcccgtcgcgcagtacgctcacacggtcagaaagttcatacacttccgccatacgatggctgatgtagataatggccatcccctcatcgcgcagccgcaaaataagttcaaataggcgatgcgtttcacgagtagaaagcgccgctgtgggttcatccatcaccaaaatgcggctgttacgatgaagtgcacgagcaatctcgacctgctgttgttcggcgatggtaagccccatcactaaatcgctggctttaaactgagcgccgagacggtcgataaccgcctgggtctgcatcaccatctctttacgctgcaccagccctccccgggaaagctcgctgccaaggaaaatattttccgcaacggtcaggttaggtgcgagctgcatctcttggtaaatcaaactaatacctgcattcagcgcatcttttgggcctttgatggaccaaggcctaccctcaataaggatctcgccgctggtggtggtatatgcgccagcgaggatcttcattagggtacttttccccgccccgttttcgcccatcagcgcgtggatctcgccggaaaacaccgtcaaatcgacacctttaagcgcctgaaatttgccaaacgacttggtaatattacgcatctccaagagggggactttattcatagcgcggtgcctgtgggtgaatgtcgatagccgctagtcaatcacaagccggtaaatgcaaaatgtcagaagccgttcatatttgtcataaagttgaatagttaaccgagatcacattcccgatagggaaatcatcgctagaggcagaggagtgattaactaacagaaaatgccagccggagccgtccatggagcaaccccgcctctccttctttgccagtgttcgtgggcgattgttgttcttcaacttgctcgtggtggcggtcaccctgatggtgagtggcgtagcggtgctgggcttcgagcaggcaagccgcttacagaagcaggtccaggagcggacactgcgcgatatgtcaagcagcctggcgctggcgcgcgataccgcaaatgtggcgacggcggcggtgcggctttcccaagtggttggtgcgcttgaattccagagtgaagcggccagtcttcaagagacgcaattggcgttacgaagttcactcactcatcttgctaatgccccgcttgccagccatgaaccgctattggtgaaacgtatcattgagcgtagcaatgaactggaaaccagcgttgcacgtatgctgaatttgggtcaccgtcgccatcttgagcgtaacctgctgctgagcgccctctatcagacccaaagttatcttcaccatctgcaggagattaaccagcgcgatgggctgaacaaacccgatgccgcactgctaaaagagatggatcgcctgctactggtggctatccagacctcctcgcccaaagctgccgtacagcaacttactgaggtgatgcaggcattgcctgcccatgctgactcgccgctggtggaggaaatcttgcaagagttcagcgccagcctgtatcagctgctgccgttgtccatcacgcttgaaaatagcgatctgagcattacctggtacatgtaccacgtcaaagcgttggtggcgtttctcaatcagggcatcaatatctatgtacaaaaggtgggggaggaatcgctgcagcgtagccaacaaaaccacaaagccttgcaatcgatcatcacgtctattggtctgtttgccctgttggcactggttatcaccgggtttgccggctggtatatctaccataaccttggctctaatttaacggcgatatctcatgccatgacccgattggcaagaggagaaaaagaggtcagcgtaccggcccaacaacggcgtgatgaactgggcgaactggctcgcgcgtttaacgtttttgcccgcaataccgcttcgctggagcagacatcacgtcttctgaaagagaaaagcacgctgttggaaaccacctttcacgctatgcgcgatggctttgccctgttcgacaatgagggctttctggtggtgtggaacccacaatacccactgttgctggggctggcaccggagcagctacagcatggtcagcactaccttcaattattgaagcagatgacgccactgcaagagcatatacttgagaacctcgccctcccgctgccaaaaacccaagagctaagacttgaggaccatcgcactatcgaactgcgtttcagtccggttcctggacgagggatggttaatgtggtgttggatcgtagcgagcgcaaagcactggaagaagcgctggtccatagccaaaaaatgaaggcggtagggcagctcacgggcggcctggctcatgattttaataacctgctggcggtgattattggcagtcttgagctaaccgctacggactcgtcggatgccacgcgtattcatcgtgctctgaaggccgctgagcggggggcgcaactcacccaacggttgctggcgttctcacgcaagcagtcgcttcaccctcgagctgttgcgatgaaagaactacttgataacctggacccgctgatacgccactcgcttccggctcatcttacgctcacaattgaagctcagcagcctgcctggcacgcctggatagacgtcaaccaactggaaaacgcaattatcaatctggtgatgaatgctcgcgacgcgatggaagggcgcagcggcgagattaaaatccgcacctggaatcaacgcgtagagcgtggtgaagggcgcaaacaggatatggtggtgctggaagtggctgatagcggccatggcatgaccaccgcagtgaaagagcaggtttttgaacccttcttcaccaccaagcaaaccggtagcgggagtgggcttgggctgtcaatggtatacggctttgtgcgccagtccggagggcgggtacagatagaaagtgaaccggggaaagggacgcgggtctgcttgcagttaccccgcgcactcacacaaagtctgatagaagtcctgccagcgcttggtgccgttgcgaatatggctgaccagctagtattagtgctggaagatgagccggatgtacgccagaccctgtgcgagcaactccatcaactgggctacctgacgcttgaaaccggcgacagtcggcaggcgctggcattgatggccgacgtgccggatatcagcattgtgataagcgacttaatgctacccggcgacctgaccggtgcggaagtgcttcagcaagcgcgcagtgtttatcctcatcttaagctgttgttaattagtggccaggatctgcggcgcagcaagaatttcatgccggaggtggaactgctgcgtaagccttttaaccaacaacagctagtacaggcgctgcaaagagtctgattgggataatccccgagagcgtcaagctttcgccctcctcccatcaggctgacaaatatttcacaaatttagtctatgaaaaccagacgggtaaacggtgttgtataaaaatgcgcttacgggcaaactttattgttacttcttcgccgccagcccttgcgcgcaagcccaagccgagctccaggcccattggaagttataaccgcctagccaaccagtgacatcaacgacttcgccaataaagtacagccccggcaccttatgggcttccatggtcttggaagagagctcttgggtatcgaccccccccaacgtgacttctgcggtacggtagccttccgtcccgttgggttgcacccgccactgctgaagattcgcaattaatgccgcctgctggggaacattaagctgcttcagggtaacatcaggcagttgttccaatgtttgcaggcactcgaccaatcgcttgggtaataattgagccagtgtgttttttagcgtctggtttggatgggcttgccgctcggtgttcaaaaaggcagccagatcgacatcaggaagtaagttaatactcacatactcgccagcctgccaatagcttgagagttgtaggatagccgggccagaaagcccacggtgggtaaataaaatactttcacggaagctaacgccattctccgccgtcaccaccgccggaaccgagacaccagacagcgtttgcacgtgatccaacaagggtttatgcaacgtgaaaggaaccaatgccgctcgggttggtaacaccttcaaaccaaactgttccgccagcttataaccaaacggagatgcccccagccccggcatcgataaaccaccagaagccacaacaagtgagttagcgctcactttcaaatcattaatgtgtagcacaaagcccgtgtcgcttttttcaaccgacaacacattactgcgcagccgcacagtgacattccccagctcacactctttcagtaacagatcgacgacctgctgagcggaatcatcacaaaaaagctgccccagcgttttttcatgccaggcgatgttgtggcgattcatcaggtcgataaaatcccactgagtataacgcgccaatgcagatttacagaagtgagggttttgtgagaggtaagccgcaggttccgtataaatgttcgtaaagttgcaacggccaccgccggacatcaatatcttgcgcccggctttcttaccgttgtccactaacagcactcggcaccctgcttgccccgcttgagccgcacaaaatagccctgccgcacccgcacctatgactaccacatcaaactgttccacactggcctcattgaataaaatcatcattgctgcaaaattgcccgcttttggctgcttatcgtatttttggttatcttcagccgacaaattagcggtgggagattgtaagtcccctgctggcagagcgccatagtaagaaaatgttatattcggtaaaactaagtaactcgctgatataacatacatatgtggtgcaaaaagactaagccatatgatgttatgtcaaaaaaaggtcatattttccttttaccaaccccccattgtcactgataatgcgccgcgttcatgtccacaaactggcgtaacgcttatgctacatcttttcgctggcctggatttccataccggccttatgttagttcttgctttgttgttcgtgctgttttacgaagccatcaatggttttcatgatacagccaatgcggttgcgaccgtaatctatacccgtgccatgcgttcacagatcgcagttgtgatggcaggggtgtttaacttcctcggcgtgatgctgggtggtttgagcgtggcctacgccattgttcacttactgcctactgatctgctgttaaacgtcagttccacgcatgggttggcaatggtcttctccatgttactggccgcgattatctggaatttgggtacctggtattttggtattccagcctccagttctcatacgctgattggtgctatcatcggtattggtctaaccaatgcattaatgaccagtacatccgttgtggatgcgctgaacgttcctaagatgatacaaatctttctgtcgctgatcttatccccgattgtgggtctggttatcgccggtttgatggtattcctgctacgtcgttactggagcagtaccaaaaagcagcaacgtattcacctgacgcctgctgaacgtgaaaagaaagacggtaaacgtaagccgccattctggacccgcacggcgctgatcctctccgctatcggtgtgagtttctctcacggcgctaacgatggtcagaaagggattggcttgatcatgctggtattaatcggtgtggctccggctggttttgtcgtgaatatgaatgcgactggctatgatattgcccgcacccgcgatgcagtcactcatgtgcaactctattatcagcaacatgctgaggcattgcctcatgccatcgcgctgaaaccactggtgccagccccagaaaccttgccaggtacacctgcgcaattccactgtgacacttcacgcgctatggtcgccattaaccatgcacaagcgctgctgaccgatctgaaaagctatgatgacctaaccgttgatcaacgcagccaaatgcgtcgcttgctgatgtgtgtcgcagaaaccgcaggggccgttgccaaactgccagaaaccagtgctgaaaaccgccgtttcctcaacaatctgcgtaccgatttgttggacacagtggaatatgcaccaacctggattatcgtagcggttgctctggctctgtctctggggacgatgatcggttggagacgtgttgccgtcactatcggtgagaagatcggcaaaaaaggcatgacctatgctcaaggggtttcagcccagatgactgcggcggtctctatcggtattgccagttataccggcatgccagtatcgaccactcaagtgctctcttctgctgttgccgggaccatgttggtcgatggcggtggcgtgcagagtaaaacggtgaagaacattatgttggcctgggtcttaaccctgccaatctctatcttcctttccggtgcactgtattggatagctttaaagttcatttaagttaattcaacgctaagctcattcgacggtaagccaattcgacgaattgttatcaccgagagccttagcgcgatgtcagtgatgagcaataaaaaggcggcctaaatcaggtcgccttttttaattctttttgccaataattcatgctaataccacaacattagggccaccagactgacaaccactaaaccacataacgcactggtcagtataaattgcccgcgtaatctctcacagcggcggataaattcgggatcatgatgatcaagatagcgttgagcaaaaatatacccgactaatctgatctgtttactgggctgaccgtgagaagtaaagaaccccccaccatcaacatactgatacaacaacgggtcacagccacgtaataccactagcagggcacgcagagatgaatagtaacgcgccatattcaccacacataccacacacaaagcccaaaaaagcgcgacggtactgatcattattatcctcccagcgatatcttgcacatccggctaactccccgaatcttggcataatcgcttactctcgctgataaaatcccccccagagctcgaaaaactgctcctatcgttcgctttcctgtaatggatctctacgtcattcggtcaataccctatctgaacgtataggactccctttattagtgtaggaaatgaaatggaaaatagcctgataatctcgcatttaagcctatcttgccgtttgttcaataccgattaatgttaacgtctcattggcattgattgtgatcaccgtatttctcgcactgatcaccgtgctcaaacattaacctcactcaaacattagccttactcaaacattaaccttgcttaataaaatcctcgctattcgactctggatttttgtaattcgcatatgcatcacaaatatgaaattccctcaaccaagaaaattcatcagcgttatacttagcattatgatctaccttaaattcaatcggtccaatattatgtaaaaataataagcggtagagtttagtgacttattggtgtaaaacgacagacagtagcattagtgatcattgtcaaaaccgtgggttgtgatccgtgaaatactcaagttagaggtcataatgatgcgatataaatgtcaggctagtgcccattcggtaggttgagtgtttgcttacacattaattaacattatggtaggagtttacttatggcttacaaacacattctgattgcggttgacctatccccggaaagcaaggtattggtggaaaaggcggtttccatggccaaaccgtacaatgccaaagtttccctgatccatgttgacgttaactactcagatctctataccggtctgattgacgttaatctcggcgatatgcagaagcgtatttctgaagaaacacacaatgcattgaccgagctatcacaaaatgcaggctaccccgttgagcaaacgttaagcggcagcggtgatctaggccaggttctggttgatgccattaagaaatatgatattgacttggtcttgtgtggtcatcatcaggatttctggagcaagctgatgtcttcagcgcgccaactgatcaataccgtgcatgtcgatatgcttattgtgccattgcgcgatgacgaaaatggcgaagacgactaaatcttcccgttgttaggtaacgctaaacgctcgcctctccggcgggcgtttttgtgatagacgtcttgccagccctcctcgttaccctcaatctgaatccagatgattttttgtcaaaatcccttgccgtatcaatataaaccagtgatatagtcgaaggacacacaacatcgtctcctcactattttgataataatagttcatataaatggtcgggagagtctttaagggtacaaggaattagtgatgaatggtttagtttctttggagtcatttctagaatcgttacaacggcgtgatgccaaccaaccagaatatctccaggccgtacgtgaagtctttacgtcgctttggccttttctggaacagaacccacattatcgtgaacaaagcctgctagagcgcttagtcgaacctgaacgtgttatccagttccgcgttgcctggactgatgataaaggccatgttcaggttaaccgcgcatggcgcgtgcagttcagctcagcaattggtccttataagggcggaatgcgtttccatccctcagtaaacttatcaattctgaagttcctcggttttgaacaaaccttcaaaaatgccctgactaccctgccaatgggcggtggtaaaggcggttctgattttaatccgaaagggaaaagtcaggctgaagttatgcgtttttgtcaggcattgatgactgaactttatcgccaccttggcccggatactgacgtgcctgcaggcgatattggcgtgggtggccgtgaagttgccttcatggctggcatgatgaaaaagttatccaataacaccgcttgcgtctttacgggcaaagggctgtcattcggtggtagtttgattcgcccagaagcaaccggttacggtttggtttatttcaccgatgcgatgctaaaacgccatggtttaggctttgaaggtagaaaagtgtctgtttcaggtgctggcaacgtggcgcaatataccattgaaaaagcgatggagctgggggctaaagtggttactgcctctgattcaggcggtactgtggtggatgaagttggcttcacgcctgaaaaactggctcatctggctgaaattaagaataagcgttatggcactatcgaagactatgctcgcgaacgtaatttggtctatttagcgggtcaacaaccgtggagcgtccctgttgatatcgccctaccttgtgcgacacaaaatgaattggacctaccagcagcacttcagttgattgccaatggtgtgaaagcggttgctgaaggcgcgaacatgccaactaccatccaggcgacagatgccttccttgaagcaggcgtcttgtttgctccgggtaaagcggccaatgcgggcggtgttgccacatccggcctggaaatggctcagaatgcagcccgtatgagctggaaatcagagaaagttgatgtccgtttacatcacatcatgttggatattcaccagtcctgtgttgaatacggcggtgaaggcaagcaaacccactatgtgcacggcgcgaatatcgccggttttgtcaaagtggccgatgcgatgctggcccaaggcgtgttgtaaataaaacgttgtccccatattttttaagatgaacgtcgagaaaaatatggggtacttcctccctcttttatttattcatagtaaacatcttcaaataaaaaacattaagtacacttataatgtgccaagccattagtttctaactttaagattacgcttatttaaaacacctctgtcatcattaatatctccctcgcacattaatagagttcaaaatattttattaacactcaaaaagagacgatgatgtttatgagttactccagggaacacagcaacactataattaaaaatgaacatgtcatgcgcagaggcattcattataagaatgaagttaaaggtgttatagcaccacaaatatctagccatcagtcatggaaagaaaacactattcataataaaaatacaaatctgacatattcatttagtcgagcatatacattatgggattatgatcgaacgttccaacaaaatgcttatgtctcattatttaatccagcccaaatccatcaggcaaaaatcgcgatgcaatcttgggctgatgtagccaacatctccttcaccgaagcatcagcagactcttccgccaatattctatttttaaattttcagcgcccaggcaatgtggcaggttatgcctatcatcctaatctagggagtttcagcccaatatggattaattacagcttcagcgataaccaacatcccagcagattaaattatggtggcggggtattaacacatgagattggccatgctctggggttgggtcattctcatgccccccatggctacacgcaacaaatgagtgtgatgagctatttatccgaacaggattcaggcgcgaactatggccaacattacttatccacgccacaaatgtacgatatcgccgcaatccagtatctgtatggggctaatctacacacccgcaccggtgataccgtttatggcttcaactcgacgagttatagagatcatttcaccgccacccacgccagtgatgcgttgattttctgtgtctgggatgctggcggcaatgatacttttgacttctctggctataagcaaaatcaaatgattaatcttaacgaactctgtttttctgatgttggtggactaaaaggaaatgtgtctattgcagcggatgttacgattgaaaatgccatcggcggcagtggccatgatgatattatcggcaatcacaccaataatattttgaccggtaacggcggatctgatcaactttggggtaacgggggcaataatactttccgctatgccagtgccagagattcaatgaccacctcgcccgatactattcatgattttaaatcaggccgtgacaagatagatttgtcgcaattaatgccctcaaccgaccgtgttatttttgtcgatagattaagttttaacggtcaaacagagatggggcagcaatataatgaagtggcggacataacttatcttatgatcgattttgacgctcaagtcagcgagtgcgatatgatgattaaatttaccggcaggcaccatttcaccgccaatgactttattttaagtacgtcactgacggcataaatatttatatctacttacccgaatcactcattaaaatttcagcgattcgggtgagaaaatgccgctaacgcggcggcgtcaccgatgaagggtatatgtcaaaacggtggctcttggtcacaaccgccgcctgagcggccacgccagccaatggctcagcataatccgggcgtttcaccaccactcgcttggtggccaacgcacgggcgggggctaacaaaccatcagcatcattatcggcccccaccaatgattgaaatacccgcatctcttttttaaccaacgcacttttttgccggtgcgggtacatcggatcgagataaaccacctctgggcgcggttcaatcgccaccaacgcggtcagactggaggcatgtaataacgtcagacgttcacgtagccacggaccgatttcagcatccagatagccccggcgcaaaccatcatccagtaatgcagcgaccaccgggttacgttccagcatctgcacctggcagcctaacgccgccagaacaaaggcatcgcgcccaaggcctgcggtggcatccaccacccgtgggagatagccttttttgatgcccacggctttcgcgacggcttcgccacggccaccaccaaatttacgccgatgcgcctgcgtgccagagacgaaatccacatagatgccgccaagtttcggctcatcccgcttacgcagttcaagccgttcagcggtcagcaccaacgccatcaccgcctgatcgtcagagactagcccccagcgatcagccagaatagataaggcgccgggatcggcgcctgcttcagataataaacaaatactgacgtgtgacacgtattagcccttaataccgtaatgacgcaacatggcatctaactgcggttcacggccacggaagcgtttgaacagtgtcattggctcctctgagccaccttgagacagaatgttgtcgaggaaggactgaccggtagcggcattaaaaatcccttcttcttcaaagcgtgagaacgcatccgccgagagcacttcagcccataaatagctgtaataaccggccgcataaccgccagcaaaaatatggctgaaggcatgagggaagcggccccattccggtgatggcaccacagcaacctgttttttcacttcatacaaaataggcaggatctgcgcaccggtcagcgggtcgaactcataatgcatccggaaatcgaacagaccaaactccagttggcgcagaataaacaacgccgcctgatagtttttcgccgccagtagtttatccagcatctcttgcggcaaaggctcatgagtttggtaatgaccagaaataaaggccagcgcctccggctcccagcaccagttttccataaactgacttggcagctcgactgtatcccaaggcacgccattgataccagaaacgcctgcggtatcaattttggtcagcatatgatgtaaaccatggccgaactcatggaacaaggtggtcacttcattgtgagtaaacagcgccggtttgccgccaacgggcccgttaaaattgcaagtcagataagcgactggtttttgcagttggccattagccaaacgcaggctacctacgcagtcatccatccaggctccgccacgcttgttttcgcgcgcatacaaatcaaggtagaagctaccgcgcagttcaccatcggcatcaaacaaatcgaagaagcggacatccggatgccaggtatcgacatcatggcgctctttggctgtaatgccataaatgcgtttcaccacttcgaataaaccttccaccacccgctgctccgggaagtaaggacgaagttgttcatcactgatagcaaacagatgctgtttctgtttctcggaataataggtgatatcccaagcctggagttcactgacaccataatgctctttagcaaaagcacgtaactgagccagctcttcttctgcttgcgggcgggcgcgcttcgccagatcgttcaggaagcccaatacctgctgtgggttttctgccattttggtggccagcgatttatcggcataactgttaaaaccgagcaactgcgctaattcatgacgcagtgtcagaatttccgccatgatctcgctgttatcccatttccccgcgtttggcccctgatcagaagcacgggtggcaaatgcacggtacatctcttcgcgcaattccgcgttatcggcataagtcagtaccggcagatagcttggcatatccagtgtcagcaaccagccgtcctgctctttggcttctgccatggctttggccgctgctagcgcgctttctggcaaacctttcagttgctcaacatcggtaatcagtttgctccaccccatggtggcatcaagcacgttattgctgtaagtcgagccaagctccgacaagcgagccacgatttcgccgtaacgcttttgttgttcaggtgccagaccaataccggatagctggaagtcacgcagagcattttctaccgctttgcgctgcggtgcggtcaaggcggcaaaacccggcccctctttcaggctgacatacgcctgatacaaacctttatgctgccccacccaagtgccgtattccgacagcaatggcaagctttgttcataagcggtacgcagctcagggctattttttactgagttcaagtggcctacgggtgaccaaatgcgcgataagcggtcatcggattcggccagtggctggcacagattatcccaagtgaacggccctggttgggcaaccacacgctctaccgcttgacggcattcatccagcgcggatttcaccgcaggcacgatatcttcaggccgaatagcagaaaacggtggcagggagaacggagtcaacagcgggtttgtcatagggcagtcctggttatgatttgaattttaataacgtttatataccaaacgccagacgcatccagcgacggagaataaattacgaatgaacaattaacatgaggtctattatcgcgaaaatcaatggctggcggccttaatccttttgatttcactttttatccaccagacagtttatactagtgactataatgtgctggctgtcgtttctggttactgcaatttgcaccctccgcaggaagaaacagcaagcagcatcgccgcaatgtacaaacatattccattcaaatccatgatttaactgtgaatatcacttggtcaaaataaaatgttaagttatcgccatagttttcatgctggcaatcatgccgacgtccttaaacataccgttcagagcctgattattgaggcaatgaaagagaaagaaaaacctttcctttatctggatactcacgcgggtgcagggcgctaccaactgagtggcgagcatgccgagcgtaccggggaatacctcgacggtatcggcaaactgtggcaacgcgatgacttacccgcagatttagccccgtacatgagcgcaatcaactattttaaccgtggcgaaaaactgcgctactaccctggctcgccgttaatcgcacgtcatttattacgtgaagacgacaaaatccatctgaccgaactgcattccagcgattacccactgctgcgcaatgagtttgccaaagacgaacgtgcaaaagtacagcgtgccgatggttatcagcagcttaaatcacaattaccgccgctatcgcgccgtggctttgtgctgatcgacccaccgtatgaaatgaaaactgattatcaggatgtggtgaaaggtattcaggagggctataaacgattcgcaacgggtacctatgcgctatggtatccggtcgttctgcgccagcaaattaaacgtctgttacgggatctggaagccacgggtatccgccgtatcctgcaaattgaactggcggtacgcccagatagcgaccagcacggtatgaccgcatccggcatgattgtgattaatccgccgtggaaattagaacagcaaatgaattcattattgccgtggctgcacaaagcattggtcccatcaggccacggtcatacgctggtaaaatggatagtccctgaatagcgaatagtccctgaataaggggctatgcctatcagagtcattgatgtacaaaaggctctcagacgctacactgttaggcaattttaaacgactctaccctcaataatgcgcgttacgcgaaagcggcaacgtgcagtatgaccgggtatctcatggaaacgaccttgatgaccaaacattacgattatctggcaattggcggtggcagtggcgggatcgcatcgatcaaccgggcagccatgtacggtaaaaaatgcgcgttgatcgaagctaaacagctcggtggcacctgtgttaacgtcggttgtgtaccaaagaaagtgatgtggcatgcggcgcagattgcggaagccatccatttgtatggaccggattacggcttcaacaccacagtgaaccacttcgattggaaaaaactgattgctaaccgtactgcttacatcgatcgtatccatcagtcctatgagcgcggtttaggcaataataaagtggatgttatccaaggcttcgcccgctttgtggatgcccacaccgtggaagttaacggtgagacgatcaccgcagatcacattctgatcgctaccggtggccgcccaagccatcccgatatccctggtgctgaatacggtatcgactccgatggtttcttcgaattagatgagatgccaaaacgtgtcgctgtcgtgggcgcaggttatatcgcggtagagattgctggcgtactcaacgggttaggtaccgagacacacttgtttgtccgcaaacatgcgccgttgcgtacctttgatccgctaattgttgaaaccctgttggaagtgatgaacaccgaagggccgaaactgcataccgaatcggtaccgaaagcggttatcaaaaacgccgatggcagcctgacgctgcaattagaaaatggtactgaagtcactgttgaccacctgatctgggcgattggccgtgaacccgcaaccgacaacctgaacctgtctgtcaccggtgttaagaccaatgacaaaggctatatcgaggttgataagttccagaacaccaacgtcaaaggcatctacgccgtcggtgataacactggcgcagttgaactgaccccggttgccgttgcggcgggccgccgtttgtccgaacgtctgttcaataacaagccggatgagcatttggattacagcaatatcccaaccgtggtattcagccatccgccaatcggtactatcggcctgaccgagccacaagccagagagaaatttggcgacgatcaggtgaaagtgtacacatcctcgttcaccgcgatgtacagtgctgtcactcaacaccgccagccatgccggatgaaattagtctgcgtgggtgccgaagagaagattgtcggtattcacggcatcggtttcggaatggacgagatcctgcaagggttcgcggtcgccatgaagatgggcgcgaccaagaaagatttcgacaacactgtcgctattcaccctaccgccgcagaagagttcgttaccatgagatgatttcgttactatggcccgaacaggcagagactcctgcacgggccatgtttctgaaataaacaaagctaggttgaacatgagctaacctggcttttatcttactaacctgacttttatcttactagcctagcttttatcttaatagcctggcttttatcttaatagcctagcttttatcttaatagatagaatgtctgacctttacctcaacgcccatcgcaattttcagctacattgatccccctatccactctcagcctgtgacaagtcatgccaaccagctatcttaaggaagacaccgctcgccaaatcgttcagcgcgccatgagcattattgattactcggttaatgtcatgaatgaacacggcgtcattattgcgtctggtgatcctcgccgtttacatcagcgtcatgaaggtgccgttttagcgctgacggaaaaccggatggtcatgatcgacgaagccgtggctggcaggcttaaaggcgttaaaccaggaattaacctgccgattatttttcgtcagcggatggtgggcgttattgggatttcgggtgaacccgataaagtgcaggcctatgctgaactggtgcgcatggcggccgagctgattttagaacaagctgaaatgttagagcaaaatcagtgggaaaaacgctatcgcgaacagttaacctctcagctcattgcccagcaaggcagtgcggcttcagtggcatcaatggcggcctatttaggattagacctcacactgccacgcattgcgctgatcgtcagtctgcgtgaacaagagcacgctcatcagcgggatctggtcgaaatattaagcaaccacagccgtgaaacattggtcactttacatgggtttgagcgggttgtggtgttattgccgctgaaccttgcacacagtgacgatcgtgaagtgacggccagaaaggctttgcgcaaattgtatgcgctgctacagccgcgttttagtctgaatatgtatgttggtggcatttttgatggcctggatgggctgcaacgctcctatcttagcgcacaagcgatgcaagaaacggcattgcgacaaaagctcacgcaaccggtcatgttctatcaagaccattttttgaccgttcttctgaatgattttgccgggagttggcaggcaggtgaactgagctctgcctggcaaacactgcgtcaggcggatagcaaagacgttctgtgtcacactctgcgttgttactttgtacagaattgtgatctgtctcaaacgtcaaaacaactgcatatccatgtcaataccctacgctaccggttacagaagatcgaagctataacagctttaaaaatcaatgaattaaattcaattcttcagctctatattggcatgaaaatagagagctaatttgtagtatcctccaaaaatcagccgttttagccgtccattttctggcggtttcactcaagctatttttctcccgcccaccataatggcgacgttgttcttgatcgcaacgtaccctactgccgcacagatcttccccaagcggccaaaatagaataatgaaagcgggagtcatatatgaccacagtttctgctctgggcgcattagtggcactgatcgtgtccatcgtcctaattttacgcaaagtgccgcctgcttacggcatgatcgcgggagcgttagcgggcggcttagtcggcggtgccgatctgattcaaaccattaacctcatgattacgggcgctcaaggcatcactaacgctgtgctacgtattcttgctgccggtattctggcaggcgtgctgattgagtctggtgcggcaaataccatcgccgaaaccattgtacgaaaagttggcgaaaaacgcgccctattggcactggcggttgcgacgatgctgctgacggcggtcggggtgtttatcgatgtcgcggtcattaccgtttccccaatcgctctggccattgcgcaccgtgcggatatttccaaaatggccatcttactggcgatggtcggcggcggcaaagcgggtaacgtgatgtcacccaacccgaacactatcgcagcggcagacagttttcatgtgccgttaacctcattgatgattgccggtattgtccccggtttgtttggcttggcgttggcctattttatggcaaaacgcctaaagcatcgtggttccaaagtcgaagcacatgagttggtagtcagtaaaaatgatactgcgctgcccgcctttggtgcggccatggcggctcctctggttgccatcttcctattggcattacgccctatggctggcattgctattgaccccctggtggctttgccggtcggcggtttgatgggtgtcgttgtcatggggcaatggcgtcacaccaaccaatatatggtttctggcctgtcacgtatggcacctgtggctattatgctattaggtaccggtacattggcgggcattatcgccaactcaggtttaaaagatgttttgattagcggcttgagcgcatcgggtatgccttcttatctgctggcccccatttcaggtgcactgatgtcaatggcgaccgcctcaaccacggcgggcaccgcagtcgcttctgcggtatttagctcaacgcttatcggaatgggtatctcagcgctggccggagccgcgatggtccacgcaggtgccacggtgctcgatcacatgccgcacggtagcttcttccatgccactggcggtagcgtcaacatgcaggtacatgaacgcctaaaactgctgccctatgagaccgccgtgggtttgatgatcgcctttgtctctacgctgatgtttggcgtgtttaatttagcgggttaaagaggtacgcatgaaaattattattgcacccgattcatttaaagaaagcctcaccgccatgcaggttgccgaggccattgagcaaggcttcagcgagattttcccgcaggccgaatatataaagctgccaatggccgatggcggcgaaggtaccgttgaatcaatggttgcagccactggcggagagttagttaatgtagaggttaccggcccattgggtgctccggttaaggccttttacggttggatgggcgatggcgaaacggcggtgattgaaatggcggcggcatctggcctgcatttagtggcaccagagcagcgcaatccactgattaccaccagctacggtactggcgaactgattttggcggcgctaaatcacggggcgcgcaaaattattctcggcatcggaggcagtgccaccaatgatggcggcgcaggcatgatgcaagcattgggcgtacagcttagtgatcaacaaggtaaagcgctcacggttggcggggcggcattagcgcaattggtcgatattgatctcagccagttggatgatcgcctggcacaaaccgatattctggtcgcctgcgatgtagataacccattgtgtggtgcgaaaggcgcatcggcagtgttcggtccacagaaaggggcgacaccagaacgtgtgcaacaattggacgcggcgttgcagcactatggtgaaaaaatcgagcaagttactgggaaatccgtcattaacgtggccggtgctggtgctgctggcggtatgggcgcggcgctgttcggtttactgaatgcacggttacaaccggggattgagatagtcaccgaagcgctaaaattagcggctgccgtgcaaaatgctgatttagtcattaccggcgaagggcgcatcgatagccaaaccatttacggtaaaacgccggtcggggtggcgcgagtcgcgaagcgttttgatattcctgtcattgctatcgctggcagcatggcaccggactatgaggtggtacatcaacatgggttagatgcggtattttcagttctcaaccatattcaaacgctaccagaagcactggaagaggcgagtgataatattcgtatcacggcgcgtaacgttgctgctgtctggaaaatgggcagaagttaattttgcccacctggctcgccgcaccttaaaatacgacagataaaattataggcagccataaaaatagtgatctcaaaacgtccatcaccagggactttatcaaataccgacggtcagatatctctggccgttgggacatcctattttccacatcacaaagaagatggtcatatagccccgacaatattgtcgctactttttagtttttcgtgagaaagtaggtatccagcaataaagttatctcactaatcctcggcattttttgttatttcaccaccctctactggctgctggtaggatgagtttcccatagagaaaaatattctattatctctaatcttttctatatccattatccagtttttatctatgcagtttttttcagtcttcatctcatcgaaacagagtaaatcagacgagtcagtactgagccgtaaatctccagtgggcatttttttataaccattgctgaagtcccatatgcttattgaaaatcgcccatcctgataaggtttaggaataccatatttttcttttaacatagttttattatctttccaccaagcgagtttccctttatcagtaatgggaaaattcttaaccattatatggtttgagtaataaccttcgctaaaattatcgatataaatatccataatttccaccggcctagaaatttcccatgcagcatagagcaccccaacagcaatcattcctaataaaatcttataattattttttagcatttttggggcgtactccagtaatctctaaggtagcttccatattagtcagaaagggtttataacctaatcctttccaacgctggagaacaaaccaaatatggaatatacgaaattggcgataaaatgggtccaaaacatcagtatcgtcaaggccaaagtgatcttgtgagcggtaatgtaccgttgcatgaaacatatcaccatcgattttcagggactttatagtgatatgtgttgcatggatagcatgaaccgtaatacccaacccatttgctctatctttccatctattaaacctaggcaatatactcttttttacagcatcactaagtattgactcatcatttgacgaataatgtccttctttccaattaatagttttttccaaaatagactgtattataaccaatgaactttttttagatttatcacttaatatctgctcttttaatgcactatccagtaataaatcacggaaaggagcaccattatttatctgcatatgcgtgatcatcttacgcataatactctgatatttccccgaaaatgaaaacgtatcggataagtgacgaaactcatcaaataaaactctggcgacttctgctttattgactttttctttcggttttttattgaaatgatccatagcaaaactggtaggtgttttttcacccgtgtaaggatccagcgtaacggatacccctctcagattaaattttccctttaattcagcttcagtcaaatcaccgttcttcatatccgcagcaccgtaatcatccatacgattgcgtgttttaaatatgcacaatgggaactgtaagggtagcgttttgggtggtgcctttttttccgtcatgtttgtttccgtcataatgctaactaaatccgtttaataaaaaaatttatccgtcataacgcaaagcggcatccagtaacaagatgccgccccaaatcattatcagaaactgactttcacgcccaaattacctaagtagccatctaatttgccatcaaaggatttttggtatttcgcatcagcatagagatcaacctgactattcactttagcggtcacccctgcgcccccctgccagaaggtttttgtgaagtcaggacggatatccaccgtcgctaccgtcacctgtgggtttcggcctaactggtgaagcacatcagtggtcagataaggcttaatgtcccgcttctcgctcgaatcactgaacagacgcaggccagcacgtacctgaccaacagagtaatccgtccccccgatctctgaaatggcatcgttgaaattcttcggactcaggtgcaggtattgatattttagctgcccctgaggctccactacccagccagcagccagtggatacggctgacccacttcggcagacatcacaacaccgtagccattatgcttggtattatgttggctctcatagttgttgcggtatagcgttgcctggctaacgatatcaaggtaaccgccttcctcggtcatcagggtgtaataacccccaaacccataagcctcggttttgatcttgccggtatcgatcgacaaatccggatttatcgcccgcgcccgatcccgtgtatcgctattctgcttacctagggtgatcatcataccgccagtcacttgagtgcctgcggcatttttggcctgatagacatcatgacccaattgcataaaccagatatttgaatcgtagctaaaacggcccgcgtcaaaattattatgctgcccacggatccggccccatgagtcttgattaaacccttcggctgctccctcggccgagccacggcgttcgtgcaagctacccaaagtagtaaaaccataaaatgcatttaaccaaggtgcggcaatatagccaggaacttcagggcggtaagctatctcttctggttcaatttctggttcaggaccgggaccgggattgatgagattagattgcaggttccaacggtagtcatctatcttatacaagaaatattcataggcccctgcgctcaccgagttactcatagtaaatgagccggaatgggtctccccatcaacggtaatcaggttaatcccgtcgcccgtggtcaatgcccccaaaccgccttggttaataacctgaaccccatggtcaccagaggcattacctattacatagagtctatccactggcgagtcgttatcacccaattgcacattaaaggtaaaactgccactcccggtgacattactgttgatcgttaaggtactgaaattatcgtagggggctcgtgaattggtgtcactgctatttgagataaagttcatctggcccaatacatgcattgactcaacatctgcatcacccgttaaattccagatactgctgctgtcgatatcaacctgtttggcgttagtcgccgcacccgtccaaacggaattattattcagtgccaggttaatattgctgttttctgcggcgtgaatatcacccaacaggacggcgtggttatcgccattcacattgacattactggtggcccctgcattacttgaggcatagatcaataacccattcccccccgttaactgcgaaccattcttcacatcaacattaatgtcagcaccattagcccagatccccggcccctgctcactatgaatctgcgagttgttcagcgtaacctgagtgtaagcggtgtgagagccagtccctgtatttgaggcataaatccctcctgcgccctggccttgagtggtaatttgactctcttccagaagaattgagctaccatcatctacccacaaggcataagcaccagcgccggtcgatagacctgtaatatttttagcgctgatggatgagtcggcaaaagtacccagcaccatacctgaattacccgtcgtctcgatgagggcatcattcagatttaggttaccgcctttagctgccgccgccccaatactgccaatccccgcagtggaaattgccatattggtggcatcaaggctctgctcagagtagaggccgtgagagttattcccttgggttatcaccgtggtattttttacgatagcggtgccacgattttcaatcgccgttgcattcacgccctcggtgataatcacgacgttatcgacattcagcgatgagttattatctcgaacccagattcccttcgcattgttaccttttgagtggtaagcccccccattaatggtgacgtcagcgtccttattaacatcaaccagtgtcgtgccgccgccgttagaaatagcatcgacattatttaatatgatgaccgcttgattggatgcactgtggccctgtgccattaataagccacccgcggctaattcgatattggcattactgaccgaggcattcccgttcactttaaataggttggtgatattaccggtggcaataaggccatccatcgtaatagaggatccctcccccacattcacaccaacagcacctttagtgatattcagtgtggtgttatctaaagtcgcatttgagccacccgatgaaatatagatacccgcaccattggtcgcatgagtactattaatggtattatccgcacccgttaagctccctccggggccattcagataaatgccatagctaccactgccactggtattgagggtggtattgttcaatgtcaatcccgtcccgcccgcaccataaatagcgtgggttaacgagtagctggtcgtgatctccgaactgtgaatatcggtattactgcccagaccagaggaatacacgccatatgccgtctgacctttcgtggtaatcgtaccaccctgtaaattcaccgtacctttgtcatttaagacaccaaaagccacactattctcggtcttgatagtcgaacccgtcagacccagcgtcccaccttcagaggcattggcaccaattgcaccaacacccgtggtttcaataacgacatcggagccaccattaatagtgctaccggaaccttgcacaaataccgccgagtggttattagcctcagtgtcataacccccagagataaccatcgtgctgccatccgttatgctggccgtttgtaccgcccagctatacagggggctgcaaagaggcaccagcaaactggctatcagtgttttacgaaagcacggggaaagcgtagagcggttttgtttcataaccatccttgggattttattggaataattaaagcaacatatacaacaagacttttattgttttttatattgctttaatttagggtcggatttttacacgtcaaatgggaatttatcccaccatatagagattatatttattctgatggttactgaatatgagactacaacactttatttgtaggagctttcccaccaaatcaagaatccaataaaaatcaaccaattaaataaaaacataatacaattaaataaagaaaattaataatgacagaaatataatttcttataaaaaccattatctatttcattttttcaaaaaacaataatcactaactctattattacataatttaccgcctctattccaaacagcaatatccctatctgattatatcgtgaaaaaaatagcattaatcaggttcattcctcattgctgtgaaaataccattaccaatacgaggtaatactcgtaacgcgaagtcatattccaaacggaaattaatacaattcttaatttctaacacttcttattactcaaaaaaacgataattttatatcctaccgttatgatggtgtccgactctgctattatcagcaagccataagtattttatgtcatattttgtagaataatcatctgcataaggcatgggttaaggccatcgaggaaaaatatgccgaacgcaccgaaagataaagtcacaccacaggtatccagtcaatccacagccccactggctgtcgggattaaaaccggcaaaaaagccatctctcatatggcccgcctcagtgatcgcattagagcctatcccgctatcgcccatattattcgtgcaacagatcgttttaatgaccggttagggagccaattcggtgccgcgattacttacttttcatttttgtcactgatccccattttgatggtctcttttgctatggtcggttttgtattagcgtcaaatcccgatctgttggctgaattaattaacaaaattgtgaatagcatcagtgacccggcactggccaccacacttaaaaatacggtgaataccgcaatccagcaacgcaccaccgttgggctgaccggcttagccattgcgctttattccgggatcagttggatagggaacctgcgcgaagcgattcgggcgcaatcacgtgatgtctgggaacgtaatccgcaagataaggaaaaattctattaccgctatgcccgggattttatctcactgattgggttagtggtggcgttgattatcacactctcactgacctccattgccggtgctgcccaagcggcgatcgtcaatgcgttaggtctggggggcattgaatggttacgcccagccatgacgttaatcgcgctatcaatttctattgccgctaactacctgttatttttatggatattctggatattaccgcggaataagccgaagaaaaaagcgctgttacgcggagccctcattgccgctatcggttttgaagtgattaaatttatcatgaccatgatgctgccgcgcctcgccagttcaccgtctggcgcagcctttggctcggtgattggtttaatggctttcttctacttttttgcccgcctaaccttattctgtgcggcttggatagccactgcccatgatgtagcggacaaccgtgttgagggcaaagacattattgaggataaagacattgaggataaaaatattgaggaccaaaacgtagaagacaagagtttaccaacacgtggagaaaagtaacttatgattatgaaaaaatcatcagtatcacgctcaataaaatggcgtagatacttactgacattgctgatcttgatcatactggctgcaggcctgatttataaattacgtttcagtaatgcggatgcactctggaagatcattagccagcaatgtattccgcatatgaccacagaagatgatccgcgcccttgtgccgaggtgaatatacccgcgggctttgcggtgcttaaagataggaatggcccgttacagtatttgttgatccccaccgtacccattagcggtattgaaagcccgcaattattaaccgccaccagcccgaactattttgccgacgcttggcaggctcgctattttatggctgagaagtacggcgcgcctatcgatgacactgatatctcattagccatcaattcacaatatgggcgcacacaggatcaattgcacattcatatctcttgtctgaagccacaagtaaaaaccgcactggccgcccatagcgccgatttccagcaacaatggcagccgctgcctggcggcttactgggacacgattattgggtacggcgcatcacagcaaccgaattgcaacaaccagggccgtttcatctgttagccgatgaaatgccaggggcaaaagaacagatgggccgttacggtctggcaataaccgcactgccccctggggattttttactgctggccgacaaagcgaacctgatgacgcaggatcgcgcctcagcagaggagctgcaagatcacacctgtcaggtgctacctcaccccccggtgcaataacacattatttcttttgctgcatttttcgcagtaacggtgcgcactgattctcttcaccttcactgggggagatcagtgccagtaatgccgctgccggcgttaatgccacccccagtgctgccgcaacggcacctcgggcaatcaacgctccggttttcacccccacatcggggcgtttaaaggtccctttgacatacagtggcgagcgcagggtcagaatacgcagccctttgctttcaggatcgatggataaattcagccgctcggtagcaaaattagcattaccggtaatattgataatggcattttcagtatcgaagacaaacacgttcggcgtcgccaccccattacgcaacgtaatatctgccgccgcacagttaattttcaccgtatcatcaccaaacagcttcgccaccagatagttacccacattcaggccgagtaactccatcaggctacggctgatctgcccctggctcagtagcaggcgcacattaccgttgctggttgctaacaggccagcaaccgagttgcctgctgcggtaaaggaggcatcaccactcaagcgccccaagctgctccgcatcgcctgtacctgtggcagcaaggcttttaattgtatgcgccggacatgcaaatcaaccttgccatgcatcggggtttggtgactatcgaggcgcaaagttgcagccagatccccttccgccatcccaaaccgcagcgggtcgagcagtaacgttccctcttttaagacgacatgggtgtacagatcacttagcggtaatgacttatcccgttcaatacgcttagccgtataagtgacatccgcgtccatcactccccaacttttggtatcaaacgtttctgtcggcaggatcttattgcccggctgccgattccgttcacctcgtagggctttttcctgattggaatcggccccgatcagcggagccaaatcggtaaaacgtaatttttccgaatcgacctgaccggctaatttcggccggggctggctgtcggtatacgtcaggtcaccgtgaatatcactgtcaccaatcttcccattaaaattttcataatgataaaccgcgccccctgcttgttttaggcgagcactcagatgaccctcggtctgataaggcggggtggcgggcagtacgacatcgagcaatggatagaggttatccagactggtcccggataagaccaattgcagatccagccccgccagatttccgggatcggttaaggtcccgacgacggccacctgagtagaaccgtagcgcatatccgcttgcagagggaacggcacattcgcgtcattcatcgatatcatgccccctattttcccactgcccactaagggctgcccctgatactgaccttctactttccagccgaagaggtaatctggagtcgtgctttttaccgtctctatctctgtcacagggttagtcgtggccgttgctgtagtcgtgaccactgatgtcgtcgtgaccgatgatgtcgtcgtgtttgccgaatgtctgctggtcaccgaattaatactggccccgcgacggacaccggtcacttgtgcgaacggcaacgctttagccagcggatcaatcaccgcgagtaaatcagcttgcaggatggcatctttcagcgttatctcaccgcgatcaaaaataatatcgccgatatccactgaccaagacgagctatccgtggaggtattggtcagattaaacgtccagttgttattgccattcgccaggcgttgcaaatgaatgtctggctgcgtcagccaaaggcgggggatacgaacttctttgttcaataatgacagcggagcaaggctggcgtcgattcgcttaagcgtcaccatctctccggtgggaaacgcgtcggagagcggcgtgccttgtgttgattgagcgtcacggctctcttgtgtgctgattaacgtcgttgggttacccaagaccaaatcttccgcatggatatgcggccaggggatccaaccgcgccagccaggaccttcgccttctcgtgaccaatccacactcaaattgccacgaatggcaaaaggccgttgcaactcggcggagactttttggttaattgttggcttcaagcgattccagtcaaaagaggcgacaaatatcaccgccgccaccaatgacaacaggataaacccactgacgcccaccaatacttttccggttcttgtcataatagctccatgcttctacgtacagtcgctgtgaatctacgtattctctctaagggtagcgtgttgggtctctatcctcgattaagacctgttcaaacaggcacttatgccgaatattttaatcaaagaatccaacagaaaaagccattaacgggccaatcataaggctccagacaatatcgttaggccttgttaaggatggaccagaatccactatttagacagtgaaaatccggttataccgttagaacccgtgaggcaggcaggagaagatgaaaggcgatcattatcgccttagggagcgttagccgcaaaacagcatcgggagtgcctgtaacccatcaaatgatgtcggtcgagaaagataatagccctgcgcagcaacggcatcggaacgctgcaccatcgcccattcttgagaagtttctaccccttcaacaataacgcctttactgtagcgatccattaatgtgactagtgtgaaaaagagccgatttcctgcctcactgtcttgcaatacagtaaacagatctctggccactttaatatattcatagcgccagctaatgaatgaggtgaaattcgccagcccgctaccgaaatcgtccaaccagagtcgatcagcttcggcaatacgcgcgaagggggtatccagtgaagtatcaacgtgttcaagtaactcaaaacggatataaggcatcgcatcaatcagccgcttggccgcgtgatcctcctgcatcgccaccaatacctgaccatcaatattgatcgataccaataccgagtgatgaacaaatatctgatgccactgcttaaccatgttcaactgctcgagcaccacatccagacgggcacccgtgctgatagtgctgaagtaatcttccggtgataaacgggtctccggtgctgaggggtgaaaaaccgccgtgagcaactcaatcgccagcaacgccccggatgtgcgataaatgggttgaaaagtataccgccgctgacattgccgccagaagctctgtccttttgttcgttcaatttctttgatctgaccgaacttccttgtctgatcaagcctctttgtctgatcaatcgcggcaaaggatggcgcaagtaaggctgatattctgttggtcatcatcagtttagtcgccatgtttcagggtaccaaacagcaatggcggggcgggctatcgctgtcatgctgacatcctgtagtaaacggttttccttctgctgatgttatcgactcaggcgaccagaactttatatagggcgataacagattattaccccgacacacgctggcacggcgcaataaagccatctacagtcgtagacgcaataatacgattaacgcgaatggagctgaacatgccttacgtcaatattaaaattacccgtgaaggggcgactgcagaacagaagaaacagcttattgccggtgtcacccagctactggtcgatacgctgggtaaaaatccggcgacgaccgtggtggtaattgatgaagtggagaccgataactggggcattggtgggcgcagcgtcactgacctacgacaatcgtcataattttgaggtacaacgtgggaaatttaccggtttcccgacttacatcataaaaaatttaaaacaccgttttaatcctattgactctggatcagccagccgtgagactataccctaaataattcgagttgcaggaagacggcaagcgagaagatcccgatgagcttacgtaacgggttgttgagcgtggccaacacacatgcagcttgaatgatgacgggtatatctctctatttcattcccatcactgatccacaaactcaggaataggccagctttccatgaccagcaaaaatattgccgttatcggcgaatgcatgattgaactgtcacaaaaaggtaccgatctcagccggggctttggtggtgatacgctgaataccgccgtgtatattgcccgtcaggtttcagcgccggacttgaatgtgcattatgtgaccgctctgggtaccgacagtttcagtgaagagatgctgaccgcttggcagcaagaaaacatccagactgatcttattcagcgtatggacaataaattaccggggctctattttatcgagaccgatgagagcggtgaacgtaccttctattattggcgtaatgatgcggcagcccgcttctggctaaccagccctgccgcagacgatatttgccagcgtctggaaacattcgattacctgtatctcagtggtatcagccttgccatcctcgacagtgcatcgcgccagcgtttgctgaaattattacgcgcctgccgcgcaaagggtggcaaagttatttttgataacaactaccgcccacgcctgtggcaaagcaaagaagaagctcaggaagcttaccgcgacatgctggcctgtacagatattgcgttcctgactttggatgatgaagacatgctgtggggcgagaagccgctagaacaggtgattgaccggacacaagcactgggtgtgagcgagattattatcaagcgtggtgccgattcctgcatcgtctgggtaaaagaaggttccgaagcccagcaatatgatgttcccgccgtcaaactgccgaaagaagacgtggtggatactaccgcagcaggagactccttcagcgccggttatctggctgtacgcctgacgggtggcaatgctcacgatgccgccgtccgaggccatctaaccgccagcaccgtaatccagtaccgtggtgccattatccctctggccgccatgccaactgcttgagcgattattcgttattaggccgcgaataacagacgttaatgaccgatcgttgcaggataaacctacagccatcggtcattttacgcctggctaacgtggccttagcccggtgttaaccgccccaacaacgctccaggttcattatttattcgtcattcgttcgttattgcgcggttgtcggcataacaggtgcagtttctaccgcttcagcaggggcaacctcttcttccgccaccgtctgtggtgccataatgccgttatagatctcctgcaacgccttcacattaacttcaggttcacctttcggttgcatcagaaccaaggtggtatcttgtgaaagttgctgttttaactcccgattcagctctgccagcgtcaacccagacaagaatgcctgccgcaatttttgatactgttccggcgcgatgtccacaacaccactttgctgtgagcgcagacgttggctcatcaaaatatcggtatcagtacgcgcataggtggcgaacaacttactgagttggtcgtttttctgtgtcatcaacgcatcaaactcagcctggctcaggccgttagcacgcaatgccgccaactcacgggcaacaaatgtcatattggctgtcaggttctcaacgggggtatttaagtgaatagcacattgggcgcgttgatactggacccggcaatcaaagcccagctttaggttcttctgattatttttctccaacacctgcttgatatgccaaaacagcgcttcacgggctaaatcgctgcgccaatagcggctcagggccatagagtcttgaatggggtgccatggggtatcccacatcaacgataacgtgtcctgtgccgcctgttcattcatcaaactcaccggttctggtggtagcggggctaaggttgcaactgccgctggcgcggtacgcttacctttcagctcagaaaacgctttactgatttgggcggcgatactacggctatcaacattaccgaccacatacagcgtcatcgcatctggggtataccattgctgataaaactgctttagcttctctacatcgaccggttgcgtcactggctgaccgggatcgtggccgattaaagaagaacctttgaggcgataacgccaccacggttcctgaatattttgtgggaaagtcgcaatggggtcggttgccgtatttaaggctgcattaaccgtttgctcacttaccgccagattacccgccgtatcagataaccatgccaacgcatccttcagcagatcaggacggttattgggtaagctcaggctgtataaggtgaaatcatacgatgtaatagccggtggcaatgggcgttcgttatcgatcccttgctgccatagcgactggagttgggcgggggtaaaactcgcgctgctcattaatgcgagacgaggcagtaaatgggcaaagcccacttcctgtgtattttcggataatgatccggtattgacgatcaagcgtagctcgatccgatcacttgggcgctgcggcgttgccagcaactgccatgaaaacccattatctaactttccctgctgccaggcagggtcgggttgtagtgcttcagcctgcacattattgctggccgccgccaataataacccaccaaccataagacgaattttggtgccctgcatgtgaacccctactgaataaactatccaatttttaaataatgcaatttttaacgttatttcatcctgccaacaccctgcattgggtggttacaccgacttgcataaatcaagccagtttttggagctcattgctatgcgactgtaattggatgaaaaataagcggtaatcaccacagtgagagccgaatgtgggagtgtaccattctgttagaccgcgtgcttttgccgatgtcactcatcagtatgaaaaatagtattgatagagaaatgaatggtgacattatgcagagacgctaccagtgacagcaagccactggtagcgaattgaagggagaaatatctgattttttgctattgaacgatatcaggacacagaaacactgctttttacattaggcagcactttattggatagcaccgcttgcagttggtcattgtccagttgcttacaccatttagcgaccacaatggtggcaacaccgttacctaccagattagtcagggcgcgagcctcggacataaagcggtcaatccctagaatcaatgccagcccagccaaaggtaaatgcccaaccgcagaaatggtggcggccaacacgataaagccactgccggtgacacctgccgcaccttttgaggagagcagcagcaccaccagcaatgtcacctgatgcataatatccatatgggtgttagttgcctgagcgataaataccgcggccatcgtcaggtaaatagaggtgccatccaggttaaatgagtagcccgttgggataaccagacccactaccgattttttacacccggcgttctccattttatccaacatgcgagggagcacagactcagaagaggaggtgcctaacacgatcaacagctcttctttgatataacggataaatttgaagatattaaaaccattgaatttcgcaatcgtgccaagtaccaaaacgacaaacagaatacaggtcaaatagaagcagaggatcaattgccccaattgcaccagacttcctacaccatatttaccgatagtaaaggccatcgcaccgaaagccccgagcggtgccaagcgcatgatcatattgatgacaccaaaaataacacgggagaagctttcaataacattgaaaatcaactgccccttttcacccaaacggtgtaaagcaaaaccaaacaagaccgcaaacagtaagacctgcagaatgttgccgctggcaaatgcgccaactacgctaccgggaataatatccagcaagaatggaataatcccctgttgtgaggcttgctcagcataaagtgcaaccgctttagcatccagtgtcgcaggatcgatgttcatcccaacaccgggttgcgccacgttaaccaccactaaaccaatcagcagcgccagagtactgacaatttcaaaatagagcagtgcaatcgcaccagtacggccaacggccttcatgctctccatgcccgcgataccagtaacaacggtacaaaaaatgacgggcgcgataatcattttaattaatttaacaaatccatcacccagtggtttcatctgagcgccgatttccgggtagaaatggccaagcaacacaccaatagttatcgccgttagcacttgaaaataaagcgttttaaaaatagagactttcataacaatgtccttttgaagagtgacacggcggcatgtcgttttactttcagtgatgaataagcaacactttcgtttaaccgtgattgcgcgaaaaataacacccccataacaatatagaaattattagttgtactggattgcacccttcgcgtgaaattaagaactgaaacgcttcaagcgacggcaataccatcgccatccgcaaaataaccagacatttataatggttattttgcggtgaactcatggtgtgatgcgcagaactaatgcggttatgggctaatgttgttatgaactagtgcggtgataaaccaatgcggttatgaaccattgggggcaaagcgcgaaaaagaggagtggacacaatgctgtcttcaaatagcagtgacttcaaataagacggggatagaacttacaggctcctgcgcaataactagcacaggagcggtttacggcagcgatcatcagcggttaattaagggcgcgactaggcaccgtggcgagactgttgatggcgacttcgttaatcgcactccatttgttgacatccgtgccaaaggtttccaatttgatatatttggcgttgataggcgaaaaggtcaacttctcaccctttttgtccgcagttatcgtttccaacccttcggccaatgattgccaggttttgccatcagtagagtaagcgatggcaaatttcagcttacgctcggtggccttaaacggcacgatcagaatattttcaatcgattgggctttatcaagctccagttgaatccaactatcacccgaagccgcccaacgtgttttaacatcaccatcagcaatattcgctggtacgtggcctttttcgctgtcatgccccgatgccgtgacggcaacaatctgtgcggcataaaccggtacacaaaacagagcgcccagtagcaacgtcgctaaaatttgttttttcatctcagtgtcctttttattgcgctgcaataacccgtggggaaaagtgccagaggctaaccgactctggggagcagcagcccggcacttttaccagcagcggccaatcggatggctgctgtcggggctatttacggccattcggctgcaacgtctcacccacattgagcaagaacagctcattgtcacgggtagaaattcgggctgaaccgtctgccatcaggtaagcaccttcggtaaaaccagccccattaaggaaaggggcaaccgcttgtggtttgttacgcaatgatgcttccaatgccaacaaagcataaggctcgatagcatccacatcggcatattgccgatccggtgaagccataaagaaaccgtcgatataacgcgttttgatgatgttatcggcaactttctccgccaaagaccggtactcagcgacctggctggcattgtagaggtccagcaaagcaaacagcgcatacggatcgctattggtggtatccagtttgaccttcatctctttgcctggcgcactgccgatatcgcccaatccctgatcgctggcaataccgcgagccaccttccacagtaaggggtcattatcgacagcataagcacgcgcataggaaatcagaaactcgttacccgccttataaggcttgagtaccgatccttttttgccgtaataaccatcacgtggcagagtgtaattcgataaatcctgaccattagcgatcatcgggcggaacgtattgtcctgctcgttgtagccgtatttggcgaaagctttcaggccatccacggtccatttcagtaaatcgtcaccttgcccccctaaatccttacccagttgcagttgcatcaaggcgttttcagaataaagggtactggtgcgccctttgagcatcatattgccttcaagcgccgttggcccgaactcgggtccgaactgccgctgtgcacggtcgccaaacttggaatgggtatccgcatcatctgttggctcttcacgtttcagtgcctgagtgaactgatagacaccgaggccagtcttggcatctcgcggcaacacatattgatcagccaaacgttttgcccacactaatgcgccctgatcttgctgatatttatacagcagggaggcggaatagatcaggtcattaccggcgttaaggaaactgagccctttggtcgcaaagaaaggaggttgttgctcaaacgtactttcccacaatgcccccattggcttaccgtactcaccgtgccggctggtttcaaggatccgccaatcatacacatgagcattccagaaaccgcgaataaaacgggtggtcgcgtcgctatcaacactgaacatcaggtcataatagggataagcatttttcagctcatgaactttctctttttcgctcggcccttccggctgcaaggttttcagatcaacaaaacggtggcctccccagtagagcaagccgctattatcttgataattttggaaatggtaacgcacgatatcttcagcacgcttttggtactgcggatcaccgctaagttcactcagcccactcataacccgcatcagattttgttgtgcagagaagttggatagcacagcacgacggccatcagggaatatccactccatttgctgcccggttcgggggtcaacaccatcagccagcaatgggctaggtttatcaccgtgataagtatctgatgctttgttcagtacattatcgacatactgcttaactacggtgagacggtctatctctgcggcttgcccggcggggatatacagcattgccagcactgacatactcaacaataatgctctttttttcatcgcttatcttacctgccagaaatcgttatggtgaggagtgacccaagggccgatgcggattatttcactgttcttatttggcgttgccgctaatctcatggcaacgccaatagccttcccgtcatacttcaagctgcatgtgcgttggctgcgctcgtgactcggcccatcaaggggcctcgcctcttcgaggccgcagcaagcagccttcctgcgactcaaattattttgggtctagatataaattagaagctatattttacccctacgcgataacgtgtttggcgctcatcggtatttttgctaccagaaacattaccgagtgccatataaggagaccaattcttatcccacttgtacgttaatttaagatcgtggctccaatcgtagttttctttatcagctaacacaacaccggctttatttgcctgtttgtaatcgatttcataatctaattgataatctttagcaattttataactaatgacactcgtcaggttatagccattttcagaggtgtcttttggcgtattaatattcgcactggtacgtttataataagggcgataacgcaatgaaacggagagatcatcaacgataactgccttgccacgcagataagggcgataattgttagacgtagagtttgaatctaatgagaatcccggctcaatagagaatgtgttattaattttatacacatagctggcaacaacttcagtgccattactgacggtttcattgaagggtttatccttatcctgagcgcctttccacttgccttccaaagataatccaaagccattagcaaagcggtgggacattaataacctatctttgtgagtgttaccactttgatcttgcatttcatgacgatagtcaatagtgactgccactgcgctggtactaatgagtgatgccactgccagagacaataatttaatattcattctagttaccttattttaataaaaattctcattattttgataagtacaaaagcagttatgaaacagtattttatttattttgatataaagttccgagatccaagccaagttgtttgaaattaataaaaaaaatttacatttgtgtgatgagcttcaaagtaaatagttttttattactatctataaaggtaattttcgtgttctagcgtgataattagaggggttgcggctatttttaggaaaaaatttacgaaataaagagtcttgacttagcaataagtcatattgtaagggggagcaattaaacccatacgcgatcatttaggctaatactctattttctgtgtttttattggttttttatcatgattaacagcgagaggtgttttttatataaagttaaaatatttaaaactgatgtaaccgataatcctattaagagtgaaattcacacaacataataaaattaattccagatagaagagataatatgccgcccttcttgctgacgagtgttttctaatatgtagggacttcacagcgtcatcggctgtcgtcagaattgacggtgggtaggcggtcattcactgcagattctcggcgagttaagtactgctggtggacaccgccatacaaagagttaacttacgtggtgagcgctgctgaaatactgggcttcaaattctgcacgtggcagtggcggagagaaaaggaagccttggcagcattgaatgccatgctctagcaaccattggcgctgctcttctgtttcgaccccttcggccatcacacgtacctttagtacatcagaaacacagctaataatgcgcgctatcgcgtcatcctctggcaaatttttcacaaagctcttatccaacttaatcatatggataggcaagcttttcaggtggttaagataccgtaagcttgagtagccaataccaaaatcatctaacgcgatcaataaccccagcccctgtaactcacgcagtagcctcaatgcttcatcgagatcctgaatctgggcagtttcggtaatttccagtaacaatttttgtggatcaatatgatagtggctaatgagcgttttcaaatgcggcaagaactgtttattttgtacctgtaagcccgatatattcaccgataacggcaggctaacaccgcgtgctttccaatcagccagaatacggcaggcttcttctagcacccagttccccagtggcaccatcatcccctcctcttcggcgaagtgaacaaagcctgacggtaaaacgtagctgccatctggttggcaccaacgcagtagcgcctccgcaccgataacctgctggcgcttcatatcccattgaggttgtaagaataacgtgaaatcgtggttttcaatcgcctgtaagaggtcattttcctgcgtcagccgcttgtgcgttttttcaatcaaatgaggctcaaataccattatctgattacgcccctcatgatgagccgccatcattgctgtactggcattgcgcatcatggattcggcagtgtcctgttgagcctgatagcgggtgataccaatactggcactggggcgcaatgttatctcgtcgaaaaacagcggttgggtcacttgcgacataatccgccgagccaattgcatggctgggaatgagcggggggtacctctggctaacacggcaaattcagttttactcagttgcgctaacaggttgctgtcatcaatgcactgctcgatccgctgtactatcgtcaacaataactgttggtgctgggcttcactcatggcgccagaaacctcttgcagggtttcaataccaatcaccaacagatgaaagtgatctgtacgcgtactggaggcaatttctttctccagcaggctgataaataatgaccgattgggcaattcagtcaccgggaaacggtgactaatgcggcccatatcagcataggcatccgctaacagttgctgattgcggttgtaattacgcaccaacacacccagttcatcatcctgatgatgcgccggtagcgtcagttgatgatgcagcaccccgtggtcaccaatatcctccagctctttggccattgcccgcagcgggtgaataatcaggcgattaatacaccaagcgatagataccgataacaccaatgccagtaacaaatatgttgagagcatggctgacagagcgctgagaataaattgatacatacggaaagagtcagcacgcaggactaaatgcgctaagggctgagggtttgcgggtacccgttccaacgcatataaaggcacggttatctgtacgggcaaggagaaaacccgcttggcccagtgtggaatgggccgctctgttggaaaatttgcgtgcaatacctgtatttggttcggtaatatcacttcagcacggctaagaataccaataggtaataggctgttgaggatttttttagcttgtggaatatcaacgctgagtatggcctcagataggggttggcgaaccgaataagcaatactttccaactggttggcataatcatctttacgctgttgcacaaagtggaacaactgaaggatgataaaaatacagatagtcaccagtgcaactactgccaccgctgccatttgtttaatcgttaatgagcgccttacccgcaaactcgttctccgccaattccgactgcataaaataaggtggttgttactatcctctaaccactcgtcgattctgtctgagtatactcgatcgcttgccgattttatcttgcgatactctaatggaaggcaagaataatgtgggtttcggtcttttcctattaggaacgccatttcgcagtactgtttttggtgttcagacgtttggtgttcaagtgcttggtgtttagacgcccctttttagtccccatcgagtaagttgtgatcccttaagcgcatttccctatcattaggccagatccgctatcctgaaatcttaacgttgacggtgccatgagggctgtagctctccctgatgggtaaaatgataacgatgctgtaaccacccctgaccaaacagggtcagaatagcactgtaataatcatcagcgccaggcggtgaattttgtacccgtcgctgttggagattcagtgtttgctgattaaacggttctgggctgctggctaaaaagggcaataatgccgcagaaaaccccactgacccatccccgttagttttaccattgtcgctgttggtcgtaaacggtggcaggccttgctgctgagtgattaccgccattggctgaaaacgcgcaatcaattcagctttttgtgggctgtccattgccagcatccccgcccacagataaaccagaatggcatcgttactgccgacatccggttttatggtatcgggctgccagcctttacctttctgccagaccacccagtccggcgaaaaaccgtttggtgcggtttccaaccacatacgctgattcacttctaccatcgcttcccaaggcccgtctatggaggaaaatcgtgccagtagttgtggcggtaaataacttgggttgagacgccaggtatcctcatcgttaaaaccaatttttcccggtaatagcatctggccaaggccgggaatatccatgacttcttcttgcgcaatacgttgcagtaataaggtacccataatcaggtaacggcggttaccccataacctgccagcctccagcaagttgtaggcaatcaagatatccgcatcggaggccgaattagggtccagaatatcccagttattttgtgagttttgcccccataaccaagcgggaaggcgggaagtgagatcaccggctgccagattgttttctgtccaagccaataaacgctcaaacatcggctgatcatccgcaaccaatgcaaaaaaaagcccataactctggccttccgaggtggttattttcgaggggctaccggggtcaatgatccgccccccttcactgatgtaatcttgtttgaactgttgccacgcgggccagttactggcggctgcgagactaaaactggccagcaacaggaacatgctggctaagtgtttaaacatgacgaccatcagaataactccctctcatcaggtgataaccggcgagaggttatcagacatcacaagtgccatcggtaatcgcgacttacccatgttgatcaaaccatgttgatcaaaccgtgttgatcaaacagaaacgaccttctctgcttcatcctgatcaacggcaaaacacgccaccatctggtcaccatactgcttaagctgcggctgcaactggctacaggtgccaaatgctctacgacagcgggcattgaatgcacaacctggcggtggattcattgggctgggtagttctccagtcaatttaatacgctcacgacgcatatctgggttcagacgcggtgtcgctgatagcaatgcttgcgtataaggatggcgggggttgttaaaaatagcctctttgctgcctttttcaacgcagcgccccaaatacatcaccatcacgtcgtcagcaatatgttcaaccaccgacaggtcatgggaaataaacacatatgacagccccaattcctgctgtaaatccatcatcaggttcagtacctgcgcccgcacggagacatctagcgcagataccggctcatcggcaatcaccacatcagggtttaacatcaatccacgggcaatggcgatccgttgacgctgaccaccggaaaacatatgaggatagcgatcataatgttcagttttcaggcccactttcgccatcattgccaaggttttttcgcggcgctccttgcgattgagctgggtattgatctgcaatggctcttccaaaatctgccccaccttcttacgtggattcagcgaaccgtaggggttctggaagacaatctgaatcttctggcgtcgcagtttttccgcactttcatcgggcttgagcagatcctgcccttgatagtatagttcgccgccggtagggatctctatcatcgtcagtaaacggcccagagtggatttaccacaacctgattcacccactaccgccaatgttttgccccgctccaatgtgaacgaaacgccatccagtgctttaaccaaacgttctggtgtaaagaaaccctttttcaccgggtagtattttttcagatcgatcgcctgtaataacggctttttacccgtctctgctggcaaactttctccctttatttcggtttcacccatcatgtttactttatgcgccgcttcagtgttcgaattcatagggatggcctccccgcatcattaagcggtgtatggcatttaacctgacgccctggtgtgcccagtaactcaggctcttcatcgcgacaacgatcagtggcgtacgggcaacgcgggttaagcagacagccttctggtcggtcatatttacccggtaccacacccggtaaggatgctaaccgcgctttatcctgagcaaactccggtaatgcgcgtagcaatgcttgtgtgtacggatggcgtggcgcacggaaaatttccgccgccttgccggtttcaactacctgacccgcatacatcacaataatttgatgggccgcttctgcaaccagtgccagatcatgggtaatcagcagcaacgccatattttcacgccgctgtaattccaagagtaattcaataatctgcgcctgaattgtcacatccagcgcggtcgttggctcatcggcaatgagcaatttaggccgacaggcaatcgccatggcgatcatcacccgttggctcatcccaccggagagttgatgtggatacacatccagacgcgaagcaggatcagggatacccaccagcgtcaacaaatccaccgcccgctgatggcgagttttgcgattgcccccctgatgcacctttaacgcttccataatctgaaaaccaacggtgtaacacgggttcaggctggtcattgggtcttggaaaatcatcgcgacttccgcgcctaccaattgacgccgctctttttccgaaattttggtcaggtcgcgaccgttaaattccagcttatcggccatcacctttccgggataatcaatcaaccccatgatcgccagtgagctgaccgatttaccagagccggattcaccgacaatccccaccacctgtccttgatcaatgctgtaactgatacgatctacggccttgaacggcgcagcgtcgtcaccaaaatgcaccgacaatttatctacatttaaaagtgccatctctctacctctattactgcttgagtttggggtcgagagcatcacgcaggccgtcccccatcaggttaaacgccagaactgttagcaggatcgccacaccggggaaggtcacaacccaccaggcactttgcgcgaactgcaacacgtcggagagcatagtgccccactctggtgttggcggttgtgcgcccatgccgagaaagccgagagccgccatatccagaatggcgttagagaagccgagagaagcctgcacgattaacggtgccaggcaatttggtagaatgttgatgaacatttggcgcatcgcacccgcaccggccactcttgatgccgttacgtaatctcggttgacctcaaccagcaccgccgcccgcgtcagacgcacataatgcggcaaagccacaaacgtcagcgccaacgaggcattcacgatagaaggcccgaacacggcaaccaaaaccaaggccaataacagacttggcagcgccagcatgatatcaacaacacgcatgatgatggcatcaacgatcccgccaaaataacctgccaataagccaaaaatgacgcccatcaccaatgacagcaccaccaccaaacacccgactaacagggagaggcgcgcgccatacatcaggcgagagaggacatcacggccaacatcatccgtgcctaaaataaatttccagcttccaccctcttcccaaaccggtggcttcaataacgcatcacgaaattgctctgccggaccatgcggggccaaccaagtcgcacctgcggcaaccaccagcataatgatgatgtagaacaagccgatcacggcccctttattgcgcttgaaatagtgccaaaactcctgcaatggcgtcattggcttcggcgcactttttactgctgactcaataagttgagacattctgcgccccttatttcttgtgacgaatacgcgggttaactacgccatagagcacatctaccagcaagttaactaaaataatcatgatcgcgaccagcaacacgcccccctgcaccacagggtaatcacggcgttgcaatgcatccatcagccaacgacccagacccggccacgagaagatggtttccgtcaagatagccccagccagcatggtaccaacctgcaaaccaatcaccgtgatgacaggcagcaaggcattgcgtaacgcatggaccacaatcacccgcatgcggctcagccctttggcccgcgcagtacggatataatcctcccccaacacttccaacatggaggaacgagtcatacgcacgatcaccgccaagggaatagtccccaagacgattgccggtaaaatcatatgcattaccgcatctttaaaatcgtcaggttccccccagatgagggtatcaatcaacataaaccccgtcagaggcaggctgtcatcaaggaacacggtatcgctgacacgcccggaaaccggggtcaggtcccattgcaccgagaccagcatgatcagcatgatgccccaccagaagataggcatcgaatagccggtaagggagatccccacggcggtgtgatcaaatattgaaccgcgtttcactgctgccagcacaccaaccggaatgccgactgcgatagcaaacagcatcgcgcagatccccagttccagtgttgctttaaagcgcgggacaaactcatcccataccgcaatacggcttttcagcgaaatgccaaggtcaccatgtaaaacgccatttacatagcggaaatattgttgatagagaggcttgtccagccccatttccgccatgacttgagcatgacgctcggcagagataccgcgttcccccgccatgatggtcaccgggtcaccggggatcatatggacaaaagcaaaggtcagcaaagtaatgccgataaacgttgggataactaaccccaaacgtcggagtatgaactgcaacatatcccgaactctctgtgtagaatgccgggctgctcataggcaacctggcttattaaacctctccaaataagcgattttattcgtcgatgttgagcgacagccatgcccaccacggtcacgtacgttgagtacgctcgggtgatgacacgcggtccctgctcaaatcctgcgacaatgacacgtaccgggagaggttatatggctcacatctgtatctgttttaacctaaataaatagaccgatgaacgttgatacgcacaccggtccggtataagggtaaaattaatccagggacacgttatcgaaatgatgtttacccaatgggtccacaacatagcctttcacttctttacgcactggctcgtataccgttgagtgagcaatgatcagcgccggggcctgctcgttcatcacaacctgagcttgtttgtaaagtgcgacacgtttgtcatggtcagcttcagcacgggctggttggatcaaatcttcaaacggcttataacaccatttagagtagttagaaccctgcttggccgcatcacaactgaacagcgtagcgaagaagttgtctgggtccccattgtccccggtccaacccatcatcacagtttcatgttcgccatctttggcacgcttgaggtattcgccccactcataggtcacgatcttggctttcacaccaattttcgcccaatcagactggatcatttccgccatacgacgcgcatttgggttatacggacgttgaaccggcatggcccacaggtcgatggagaagccatctggcagacccgcttctttcagcagttctttcgctttagcgggatcgtaagcgtaatctttcacatcatcgttgtagccccacatcgttggtgggatcaggtttttggccgcttgccccgcgccttgataaaccgcatcaataatcgcgtctttgttaaccgccatggtcagtgcctgacggaccttaaggttatcgagtggtttcttctcaatgttgaaggagaggtaaccgacgttcagacccggttgctccatcaggttaatcgttttgtcttctttcatccgggcgatgtcagccgggttcgggtaaggcataacctgacattcgtttttctgcaatttagcatagcgaacggaggcatctggggtgatagagaagaccaggcgatcaatttttggtttggtgccccagaaaccaggaaacgctttatacagaatacgggagtctttttggtactgttgcagttggaatgggccggtaccgattgggttcaaatccactttttccggggtgcctgctttcagcatattgtcggcgtattcagcggacaggatagaggcgaaatccatcgccaggtctgccaagaatggcgattccggacgggtcagttcaaagcgaacggtattgtcgtcaactttcaccacattggtgattaagtcgcccattcccataccctggaagtattcatagctgccaccagaaactttatggtacgggtttttatcatctttctgacgcatgaatgaatagataacatcatcagcattgaaatcgcgggtgggtttgaaatctttattatcctgccatttcacacccttacgcaggtagaaagtgtaggttttaccatcttcgctcacttcccaccgctccgccaggctgggttcaatttcggtagtcccgattttgaactccactaaacgattgtaaataggtaccgagcttgcgtcataagttgtgccagaagtaaagagttgtgggttgaaaccttccggtgacccctcagaacaatatactagcgtttttgcctgtacactggccgctatagtcagtgcaaccagcccaataccgaatttcagtatccctgttcttctcaaggaaatcgtcatcgcttgtgctccattatggtgatgtgtgttgtgtatacggccagactctataattttttagtccatggactgtgccgttttggcccgttgaacacagggatgcaggattgagataccagataaaattctatccaggcccccattttggctgtgtgaaatcacctcaattgctcttgatgactccccctgagggtaccaatttggcaacagttgatagcgacgtcaatacagtctgaaaggatttatctagacaatgagaaacagtaagcaaacaacaaaaaaacatattattaacattgctagcatgaaaagttatgctaacgcacataccccagtaacattcactggttaaatgcaataaggcagttgcaacccccagtagcaaacccaaaaactttgttgctaaatcagatgtatctgtacagatttttttgaaattttgacaaaaaacaggaggaaactctgcctcaacagccgataaatggcgttactgtggtcaccactccccctcttatccaacatcgggtgcgcggttaaaaaagaaaagaattcacccttccacgctgactcacccaagaaaccacatagcttcccaaagaggtgcaccatagtgatgcccctaatcagggcagcacaataaacactcaacatcagagaaggtatagaccctaatattgccaagttagcgtaaacccaaaaaccaacggatcggcatcaaattctgcgggtttggttatcggcacgccgacattaaaatcgtaaccaaacgcatgataatttccacgagtccctaccacggcccccgctaaacgctcgcccaaaagaaatggttggccctgctcactcacctcaccataatccatgccgatatagaattgctggcccacgaatgtctggccgggtatcgggctgatccatgaaatatcattttttagagaccacccccgcgaccccgtcagagcgttattctcattaaaacctcgcactgaactcctgccaccaatcgtaaatttatccagtgaactaatatccgagtaggtatgttgctggctgaaagcgggccgatactggaaggactgtgttccgatcttaaaagggatatccagtgagctggtgatatcgaccaacctcgccggtgcagtgctcattttaccgggaataggttgggcaccaaaccatgaagccccctgttgataacgaaccccccctctgaacgtcgcccatggcatgtaatgtagatgctcaatccctagctgccagtccgtggtattgaaccgctgaatatctatctcccgatgggtccaaaaactggcagactgacgaattaacaccccggcataacccactgttttataatttactccacgggtgagtaaatgttgaatttgtgtatccaatacagaccaatgggaacgatagccaaattttttaccggcaagtcttttaccggcaaaagagaacgattgataacgctcaccttgattgcccgtcatgctaaatagccagttgccatacgggacagaataatgaaccccgtagctgttgtgccctttatcgggttggctatcaaggtcacggttaacagagaagtagagtaaatcactgagagacaaggggttataacgggataatggattatcaaaagacaatatcaggcccgtacgatagcggccaacggcatcatgccctgcatcatcaaggtaggcattaatacgccagagacgtgattgctggcgattcacgataatctggctgcttaaatcttcccggtttaattcgacatccagggtggcattcactgaagtcaagcgctgcaagttttctaacccttgctcaagatggcgtaaattaaccaaatcaccacgtttaccggggaaaagggcgctgagatgagcattgccgacgctgtcttgatgatgcctgatatcctcaatcttgccgggcattaatttcagcattaaagtaccgtcacgctcactgtcaccgacaaaaaccacacgagacgtgatatagccatcaaccactaattgttgctgtaagttagccacaagcactgacagcccctgttcccccaagcaacgcccgtgagcttcttcagccttttcttttaagtgagctgcatttgggaaagcatcaagattaatcaattcgacattattaattgctacacattgtacttcatcattataaagattctctggcagaaccggttcactggccagttgagcatgtgatagaggaggaataatactatttgggatctgcggctcggctatatccatttcaagcaggtccatttctggcaacgccatttcagcaaaaactttaaacggaagcatcccaatcataatttgaagatataataggcacaatatcccccaccaaaaatctccaattttatccctccccctcacatttattttaaatatcatgctaatgaactccatttcaatcaaaacacgattaatacaaaatcaataaaagttagccacgaaagcaactaactttaaataaaaaatcatctctcacttacaaagaaattaattaaaatcagaaattattttaccggtatcattaattaaaacagtttcattcaaatccactccacctaacccaataatagcccctctattgtttcgtatgttattaactttaccctctattttccctgaagaaataatactccctccagtattattaaggttattactatgaagttttattcttacccgcccttgcgttgatgttgctttaattgtacctttaccatttttgatggtgttaactgttgctatttcaacgctaccatttttatactctatttttccaccttcattatttaagccacgagatgttattttaataccttgagaaggtaataaatcatactcaccattatttaatattgtgccaccagagttatttataacaccctcgctactcagtaacaccattttccctgatatattcccattactgttatctatattggctgcagaactgaggcttagtgtatcgttcgcgcgtattgcccccttatttttaatcgtgccatcggttgcatggatacgaattttattggtgtacattcccccaatttcgctgacatccaaactaaccgtacctggtactggtgtattttcattgcctaaacgcgacacttgcaatggttgcccaggcaaagagaaacccactttattttttcccgtgacaatatagccatcgtccgcattgatctcaccactaaccgtaatagtgtctgcgaatagatcaagataagtcttgtctgcccccttataccgtaaacctgttctcatatagtaagagggatttttttcaatattgatatttccctgctcaacaataaaactgtttagtttattatcagaaaaagatggcgtacctgtcgtcaatgtcacatgagaggcattagtaaaagagcaccctcgacaattaatacctgctggattggcaataataatatgcgcatttcccccgtcaacacggagattcccatctaatagactggcatgtgatgagttgacttcatttaatataatggttgccgatttgtcttgtaaaaaagagttgccattaacctcttgagctaagcgattattgagtgtcgtgacatcgaataagccattagcgaccacatcaaatttagaatacttgttatgtgataacccattttcatcaggcgcttgaatattaacgacagtctctgtcataccgatacagtaagaggtaagcgctcggcatgtactgggcggtgtttctataatagagacttccgcttgctgtcccgctggggcctgtatatcaggaataatattatcagcataagcaactgagctcccatagagcgacaatatgatagagagaggcaatatagacaatccctgtttcgttttaatatctgtcaacttcatattattccccttattaaataattaatgtgtttgttatgttgtgaataacacagtctaaaaccgatatcattaccggtttttcataaaaaaaagtcaacaacacaaaggagatataatatgttagaagaataaaaaatagagatattcaaaaaatgacaataaattaaatataaacacaaagtctttataagatattatatgaattattattttgataatttatataatcagaaaataacgagataggataagaggacgtaaagaaaaatggcacaaaaaaaccctgacgttaccgtcagggttcttaaatttggtcggcgagagaggattcgaacctccgacccactggtcccaaaccagttgcgctaccaagctgcgctactcgccgaatcggggcgcatcttactgctacagctccggggcgtcaatcactttttaataacctgcggatgactgctgttaaaagcatcacccgcagtgaaaatggccgccttcacgctcaaatcaggttgtcgcttgctttaactgcggcgattgcgcccgcaggaatggcaataagaagaaagcagataaacatgccgccacagagataaccacaaagaaaccattccaatgccagatttccatgacgcgagcgatagggtaacccgataaagccgcccctaaataggcaaatagcccaacaaagccggttgcagcgccagcggcatccttatgagagcactcagcagcagccataccaatcagcatttgtggcccgaaaataaagaaaccaatcgcaaagaagcagcctgcctgtaagacaaaactgatgcttggcaacgtccacagtgatgcaactgagaggaagataccaatagcaaaaatcaggttcatcggcccacgattgccacggaaccacttatcagaaccccaacccgcgaccaatgaaccaataaatccacccacttcaaataatgaaattgcagagttagcggtcagcaacgaatagcctttctcttgggtcagatagaggttaccccagtcattaatcgcggttcgaacgatataaaccagcacataggaaacggctaacaaccaaatatatttattggttaagacataacgcttcacaatttctttattagacagcccctggccttcggattcctggatcagctccatcgcatcattgcgccatttacccacacttggtaggcccatggtgcttggcttatctcgcagacgccaacacatcagcaaaccaatcaccacacctataataccggggatgatcatcccgtagcgccagctaaagtgcagagtaatcaccccgacgagcaaggggattagcgccccgccaaagttatgtgaggtgttccagatagcccaccagccgccacgttcagaacgcgagtaccaactggtcaatattttggaacatggtggccagccccaaccttggaagaacgcattgaggatccacaaggcgccaaggaccaaaagtgatgagctcatgccaaacaggatattaataatccccgtcatgaccaacccgatccccataaaataacgcgggtttgagcgatcgctgatcatcccagagacaaatttagagcagccataagtgatgtaaaacagggtgcctaaaatcccgacatcagacatgctcagccctagatccgtgagcatggcaggcataataaaattgaagcttttacgagtgaaataaaacgcagcgtagccgatatacatcgtccacattaattggatacgccaatacttataggatgaatcaatttgtgtttgatccgttactggcggtacgttatcgcgacttttgaggaaaaaccacatctcgggcctcagggtattttgcaagtgcaataatcatcatctgcatgtgtatgaaaatacacgggggaattctcgctgctaacaagaatatttcttagtttccttttgtagacaaagaaactgtgggcagggtcacatttaagcaagtgccgttatcaacgctgagactcacattacccccaaacgcactgacccgtgactgaataccccgtagcccatagcctggagtaattgaggctaaatcgatacctttaccattatcgctaatcgttagatatatctgttggttatcctgccgtgcattaatttcaattcggctggcggcaccatgccgataagcattggtcaccccctcctgacatatacggtaaagcgtaattttcaacgtctcatccatcggatggtcattgacctgccagttaagcacaccgagcaccgattggtcttgcggaatgagttcgcgcatcaatgcagcgatggcggccgacagcggcaaattatttaatgccgctggccataatttagccaatacgtcatggacaccatcataaacccgcaatgccgcagtttctatcatctctgcactggtcagtaccggttgctgggtggtcagacgtttaataatactggcttgggtacggataaccgttacggtttgccccacttcatcatgtagctcacgcgcgacatcgtgccgtgtatgctcctcagaaaccactaatgctttagccaactcacggttttcgttcaattttatttgtagttgatcgttcaactcccgctgtcgttgaatgccggatcccaagagcagacctgttagactttgtgccaacagtgaaagtagcaagccacgatgagattcaaggggttcaggtgtattaatcaacagcactacaccattgagtaacgtggccgccaacgccccctgccagccatagcgatatgccataaacacgatggggatcgccaaacagaacggtacaaataagcgtaaatctgtttcagtcacttggtactgtaaccagatactgatggcaaatagcagtagataccacaggatatgccgcaaccgcaggttaaccggtttatgtatcaacccaggttcaagcggtaaccagatttgacgtgccagatagtgccacagcagcaggcaggtaggcgcgatggtaaagccaccaaccaaccctaataagagcgccattgcgccctgcccactggctatctgccaccccaacgcctgtattagcgcggcaaccgtgataacgcccccctgcattaacggccattgccattcgctctcattttgctgatggcgcaataaccacggggaggcaaaaagggccaataaggtggtcaataacaacagcggcaaggcgacccacaactgatataaatcatcgaattgatcggctaatagccaccacaacaggacatcacccagtaaaatgccaggccagtaagcacgtggactttgtaataaaatccccatacgcagaccaaatgggaacaacagcagcgactgtaaagcccgatcagctaattgtgtccctatagcccacaggcagaaagccgcagtaaaataaataaagaataacgccagcaacatcaccaagcgctgtatcatagattcagtactttcttagccagctcaacattattgctgatgcctagcttggcaaataaattagcccggtggacatggaccgtttttggcgatagcccgagcgactcggcaatctcgcgtacttccatgccttcagccaacagcactgcgatctctcgctcacggcgggtcaatggatcgacagcaacccgtgccaattgttgggcaatttcaggcatcagatacaccccgccactgcctaccgttcggacggcagagatcagatcttcgggcttacagcgtttagaaagaaagccgcgtgctccacgctccagcgccgtttctaccaacgcaggactgtcatgcatagagagcatgatgacccccatccctgaaggtaacccttttaataaatctaatccgttctcatcaggcatggaaatatcacaaatacagatattcgcctgtaagcccggcaacccagcacgagcctgcttggctgagctaaactcaccaacaacctggatatcctcctccagcgagagtagctgtgcaaaacccgagcgcacaatgtcatgatcatcaataaatacaacacggtaagtcatggtgtggctccatctggagggggatcggatttgaaagtataccttagccgtgaaacaacaatgaggaggcacatcaaaaattgggccagacttgggtaagcctggccagttacggctaaattgcgggtgtaagatggcgatcaggggcctggcaccagttatttttagcatcaatcccaccatccggtgaggtatagcccatgcaccccaaaacagaatcaaagagttctgcgtggcgatgtgttttacctacccgctgttctacctgtagttgttcaaaagcagcaagatgctctggctgtgccaggaatttatctgatgcccagaccatcaatggcactcggaattgttccggaggtgccatttcacgcggagtaccatggaagtgagagttatcactgatagattcaccatgatcggcagcatagaataccaacgcttttttatccctcatttggtcaatcacattggcaataaacgaatctgtgtacaacacgctgttatcaaaagcattaatcaactgctgtttactgcaaaactcatcaactcccatacattccggttgataacgggcatagctgcgagggtagcgttgggaataaagataatgtgagcctttggtatggagcaccactaaatgtttacccaccggataacgccctaacgactcttttaattcatcaaccagcaacatgtcatctaccggttttccatcgttacgtttctctgatgcaatcagctcacgaaatgagtaattattggtgttcacgttgttgtagaaccacatttcactctgcatggcgaacaactcggatgtgaatcccaacgatttcatgacagcaaaaacgttttgttctttcagtgtgcgttgtgcgttatcttcaacgccaccttcacggacaaacatgcagcgtagagaaagtttggttgaggtatcacaggactcaccacggaaagcagctaagttcttttctttactcagacgaggggtagtatcacgtgagtatcccaacaaccccatgtggtcccagcgggtcgtttcgccgataataaacacgacataggtatcatcaatacctgcgggggcaacataagtatgatgttcagcggggttatacaataccgccgcgtcatacttctcattatattgggtataagcgtacaaacctaaagcggccaaccagttagatggcaaataagagtgagcaaccaccccaccataactgggtaaatccaccgtttttagctgttcgtccagagcttgagctttatccagatagcgcaacggcagccaaaccagcgccacaacagccaccatcaacaatacgggtttaatacgttgcccaggcgttaaacattgctccagcaatgttaaccgcaggctattcttccagataagcagtagaggcaatgcactgaccaacaccatccaaataataaaatgcagcccgataacttccttagaaagatcggtatctgtggtcaatactgaaataacgatgccgtaaccaatcaccacattgaaaaatgtcatgtaataactggcagcaacagagataagcaccagcaacgaggcaaccactcggtaaaaaaaccttccaccaagtgagatcaatcgcataacaaaaaaggtaaacagaataatcgcgatcacttcagtgattgctgataccacttttatcccttggataccctgactgaatgagtcaaaacgacgataaaagacagatatattcaggaaaataccaatataaacagccaacaacaaagaaagactttgctgtgataaaaatttcactctgtccatataacgctaggtctccaaagacactatttacggcttgaatcaatcagacagtgaacgccccctcaggttcagtatggggccagttagcacgcggcgaattctacctataagatttatcttactcaatcttaataggtcagttcgcgcggtaattcataacctatagaaataaccctgatccacatctgagaaaatgacgaaaaacaggaaaaacaggaaaaacaggaaaaacatccaagttaaccgacaaggtagttttatggggcgagaatgcaaaaatccctaatcgttggatgtccaactttcgggattcacggcaaaaactggggattccattctgctgaaaaaccccgatgacccgatcttgaacggtgaggataggcagaagagtaaaatgcccgcgccagagatggcgcgggtcgagctcccaaggaagctatttttatacagggaagcgggcatctttacttgctgccggttctctccgtcgcgagcacgttgccagcagcctggttttttgcaggcaaattattgaaccggcgcatctatcttgtcatctatccgttgcaacatatatggatagaacgggttcgatgagatacgcatcagcgaatctagcccaaccactaacacagcccgctcaccacgagctgcaaaagtccccagactaataccgtattgatcacgcggatcggggtaacggccatacagcgagtcgctcatcgggaagggtaacgccacgtgagataacgagaagatatccggtggataaaccaaccctgtcggcacagatgtttcgttcgtttcaccagctcgcgtggttaatgccagagtctcattactttgcggcgaaacattggtaatcactgttgtgctgtaattacgcggtcccggcggtaataagcgcgccaaggccgtataagatgaagttctcaataatgggccaaaactagcagcgcggttcaaatcgaacaatacgacttcgctgccattattcggcaggtggttgtaaagcgcggtgaccactgcccgagtacttaccgttgaatccatcagtgactggaacgtcaggattggtggcaattcgtccattttattgtttctggcatcacgggcaatatgctgttgaagcacagaggtcaacaaataagactgacgcgccgcatttaccgggaacgaattatatttgaaagggttaaactctggaacgatccccaaccaagcggctttggcaaacgctgggaagatagcgggccaaccggcaataccggcaaagcgagcaaaactggtcacaccaatcatcggggatattaagataacccgagcaggttttgccagtttaggatcatccatggagtccagcgtgtacttcattgccagcgcgccaccattggagaaaccaacgacatgtaatggcaaatctgggccgctaagtgctttggcttcacgtactgccagccgggttgctgccaaccaatcctgccattcaacatcggttaacgcggcgggtaccgaaccatgcgctggcaagcgaataccaatcgcaacataaccacgctgacgataattttcagcaatgtgacgcaagctataaggggtatcggtcaaaccatgcagtaatacaaccgcaccttttggctcaccttcaggttggagaatataagagcgattccaatcatttttaaaatgagggggataaattgcgctaccagaataataacgattcagaggaacctgagtacttggttccagtttctccgtaacattaattcggacttcatcgaaaatattattttcagtttttatgtaatccgcccaactggctttatctatctctgctgcgcgcatttcatgaggaacgaaagtgtgccaaagttcaagctttggaccacgttgtgtatcgtagatacgtattgccagtatggtaatacttattactaccaataccagtacaatccgtttaatccatcgcttaatcgctatggcaggcatgggccgttactccgtaggtctataatttctcacaattgagggcagtttatcaccgtctggtcacgtcagtactttaaacggaaatgattatcttggtatatagtacgttattaataaaattaacatgtagtcgttactgccaaataaacatcgacaaacagcttaattatccgttattcctcatttcactctgtcccctaaataatttaagttgcagaaaggcggcaacggagcgacaaattgggtcgggaaccaatttgagcagaatgccgaacagatgttggaattgttaagacaaaatacggagctcacaaccctaaccaaccaattaaccaccaattaaccacccaccttaaggcgatggctgttgagttacaccaaaaattggtacttaacccaccctcactaccgccacatgcttgaaaaaaataaatcaggccgctgataccccatcaaccgcccgttaacattcgttcccttacgatggtatctcactgcttttcacccgctcttgaataacgcatgaaggggccttacgtaaccaaatccaccacgccagtgtcattaatgccacccacgccaggccgacatacatcgcaatacgagtcgcagggaagtaacctaaaacagcaataataaaggccataaagagaatggtaaggataggcgctagcggccaaaatggcacggggaatgccagccgagcgacttgcgctttgctcattgagcggcgcatagccacttgtgataccagaatcattagccacacccagacggttgcaaaagtggcgatcgatgcaataaccaagaacacgtttttcgggataaggtaattcaataccacaccgcacagcagcgtaatcgccatcaccaagatagtcatatagggcacgccattacgtgtcaatcgactgaagctcttaggggccaatccttcctgcgcgaggccgtacatcatacggccagcaccgtaaatatcactgttaatcgctgaaattgcagcggttattaccaccaaattaagaatattagcggcagagtttatgcctaaactactaaaaatctccacaaaggggctgccattttgcccaatactcttccacggatagatagccatcaggacaaacagggtcaaaacatagaacaatagaatacgtattggcactgtattgatggctcgtggtaatacctttcccggatccttcgcttcactggccgtcaccccaataatttcaattcccccaaaagcaaacatcactacagcaaatgatgcaatcacccccgtgatcccatttggcataaacccttgatgagcccataaattactgacgcctgtgctgtcatgccccgccccgaaaccaaacatcataatgcccaaacctgcggcaatcatggcgataatggcagccacttttagcaacgagagccagaactccatttcaccaaagactttcactgaacatagattcagcgcaccgataaagaaaatgatacttagcacccatacccattggggcgcatcaggaaaccacagccccatataaataccaaaagcggtaacatcagccagtgccacaacaaccatttcaaaggtataggtccagcccgtcaggaaccccgccaatggccccagataacggctggcatagtgaccaaaagagccggccacggggtcatgtacggccatttcgcccaaggctcgcatcaccataaagactgccgcaccgccaatcaaataagctaataacactgcaggccccgccagacggattgcctcagccgaaccataaaataggccagtaccaatggcagaacctaatgccataaaccggatatgccgtgcactaaggccgcgcttgagcgtggatgaatcattcttcatggtacattctcgcaaagtttgtgccttttcaggcagggattcagagaggaggatccggtaatcagagcctccattgaactgggtttttacagcgaactggtttttttacagtgaactgtttttacagctaatcgattgttttacagctaatcgattggggcaaatggcaacgtgcccacagcggagagaagcgacggagcgtttatccccttggcatttgacgttgcagcgtagttagcgtcattttctcctccaaattactgacctaagtcaattcagtggaatacgctcgtttattacttgtctgcaacgccaatttcttgggaaactgctgtatttggaaactgctgccttgggaaatgactgtcttggaaaactattgttattaaagacttggcagtaattttgctggcatcaactcattcatatgacgttgtgcaataagctggctagcaacttcaatatcgggggcaaagaaacgatctttatcgtagtaagtgacgtgctggcgtaatagttggcgggcgggctccagtatggcggaagttcttagccctttgcgcaaatcaagcccctgacacgcagccagccactcgatagccagtatattccgtacattttcagccatttcccacaagcgtttacccgcccgaggggccatagagacatgatcttcctgattagcagatgttgggatgctatcgacactggcggggaatgccagccctttattttcactggttaacgccgcagccgtaacctgagcaatcataaagccagaatttacgccaccgttctctaccagaaatggaggtaactgagacatatgcttgtccatcatcaacgagatacggcactctgataatgaaccgatttctgccaacgccaacgccagattatctgctgccatagcgaccggttcagcatggaaattcccaccagacaagacatcaccctgttcagcaaacaccaacgggttatctgaaacggcattagattcaatagccagcacctctgccgcctgacgtatttggcctaaacatgcgcccatcacctgtggctgacagcgtaaagaatatggatcctgcactttgtcacaattcttgtgtgattctgagatttcactgcgttcaccaagcagatgacgataagtgctggcagcatcaatctgcccacgttggccccgaacggcgtgaatacgggcgtcaaatgggctacgggatcctaatgctgcatccactgtcaggcagccaaacaccgaagcggccgcatagagatcttcggcctcaaataaaccacgcaatgcataagcggcagagacctgggtgccgttaagtagtgccaaaccctctttcgccgccagtgtgaggggctgcaaacccgcttgcgccagtgccgtgtgtgcgggcaaccattcaccctgatagcgggcttttccttcacctaatagcagcaagctcatatgtgccagcggagctaaatcgccagaagcgcccactgatccttttaacgggatatgcggataaaccccagcattgaccaaggtaatcagcgcctgaatcacctccagccgaatacctgagaaacctctcgccaggctattgattttcagcaccataatcagacgcacaatcgcatcatcattcgcttctccgactcctgccgcgtgagagagtacgattgagcgctgtaagttttccaagtcttcggtggcgatacgggtagaggccagcaagccaaacccagtgttaatgccatatgccgtgcgctgttctgccaatatggcttgcacacaatccacactttgctgaatgggtacataggcactttcatccaatgtgatatgtacgggatgttgataaatatgccgtaagtcagccagcgtcatctgaccaggacgtagtgttattgtcttcatgattttttcccctgagttgcggcaaccattggtaggttaagtccttgctcttgcgcgcagttaaccgcaatgtcataacccgcatctgcatggcgcatcacacccgtagccggatcgttatgtagtactctggcaatacgttcagcggcttcatcactgccatcacaaaccaccaccatgcctgaatgttgcgagaagcccatccctacgccaccaccatgatgcagagatacccacgtcgcaccgctagccgtattcagtaatgcattgagcagcggccagtcagacaccgcatcggagccatcctgcatcgcttccgtttcacgattagggctggcaaccgatccagaatccagatgatcgcggccaatcacaacgggcgcagagagctcgccgctgcgcaccatttcgttaaatgccaaacctaatttggcacgctggcctagaccaacccagcaaatacgtgctggcagcccctgaaaacgaatacgctcacgcgccatatctagccaatgatgcaaatgtgcatcatcagggatcagtgctttgaccttagcatcggttttataaatatcgtctgggttacccgacaacgcgacccaacggaatgggccaataccacgacaaaaaagaggacgaatatacgccggaacaaaaccggggaaatcaaaggcacgaataacccccatatcgtgggccatttgacggatattattgccgtaatcaaaggttgggatacccatgttgtggaaggctaacatcgcttcaacatgctctgccatggagattttcgcggcattgatcaccagcgctggctcatgttgagcgcgttggcggtactcttcccaattccaacccttcggcagataaccgttcaatggatcatgagcactggtttggtcggtgaccatatcaggccgaacaccacggcgcaccagctcaggtaagatttcagccgcattgccgcacagtgcaatagaaaccgcgacacctgtagcggtatatttctcgatgcgcgctaaagcatcatccagatcggttgcttgctcatccacataacgggttttgagacgaaaatcgatgcggctttgttggcattcgatgttcagagaacatgcaccagctaacgttgcggccaaaggttgcgcgccgcccattcctcctagcccagcagtcaagacccaacgccctttcaggctaccgccaaaatgctggcgacccgcttcaacaaaggtttcataagtaccctgtacaatgccttggctaccaatatagatccaactgcccgccgtcatctggccatacatagccagccctttggcgtccaattcattaaaatgttcccaattagcccaatgaggtaccaaattcgagttggcaatcaataccctgggcgcattactgtgggttttgaatatcccgacaggcttacccgattgaattaacaaagtttcgtcatcgtttaaattgatcaggctttcaacaatcttgtcatagcattcccagttacgggctgcgcgaccaataccgccgtagaccactaattcttttggattctcagccacgtcaggatcgaggttattcatcagcatgcgtagcgcggcttcagtcagccagcttttcgctgtcagttgcgtaccctgcggggctcgaatctcattatctcggaatctgttttgagtcgtcacggcaatttccttcaaccagtttttcaggtgtcaaacgacattactcaccttgagtgcttattaacatatactcgtatagacaagtacaatcaagatcagagaaaaaagccaaataatgatttactgaaagaaacgaaaacacaaaaatagtgcttataatcaattaattatatcgttttttattccgtaaaaagggaagagtaaagaattttcaacagggtttttcccataaaaccagcataaaattggtctatatttgcgcaccaaatcacatataattcacataaattttacattaaaactcaaaattgcgcgctggctcgcagcaggttaggacggacttcgccgtatatttcattggtttttaacttcattagtttatatggcgcgtattaccgcattggcagtagctttggtgctgacactctatttatgcactgctacaacattatttacgcactgaccaaatatcgtgagggaagctaataagatgaaatcatgggtaaatatattttaattaatttaaatgacggtatctctgcaggtgattttatatcgaggaagcgaaatcaaccaagaaatatatattgaaattattaactacaaaataatatatgcacctataaatagtatttaaaataattcaaaaaattaaattacacattgatatttaccctccgggaaatttatgttttattgtgcacctccataaaaaaggagtgtgtcatggaacttaaggatattggtaacaccgagcttattgagctaaaaaacttatcaataaataataattctcttttttctaagtgcgaattcaacaatcctacaggtagccataaagaccgaacatttctgcatatcctcaatatcttggaagaagaaaataaaataattcccggaatgacattgatagactgctcaacagggaatggaggtgcagcactggcttggattggtcaaaaaaaaggctataaaattaaaatatttatgcctgaaggcatgactgaagaacgcaaagaacagatctattcatttaaagaacgtgtataaaaatgctcaggtagtgaactcaggaaaagcattaaccaccgtcaatgaatttacagaccagttgcctgccctcagaccagcagtcttgctagaagtcgcacataaagtcatacaaattatagatatggatatcgataaaatcgtaacagaagaagataaaggtgctcccctcgctactgctgtttccttgttatcaggcaaaccattggcgatggctcgttggtatccatacagtcttagtgagttaaataataatgttgtaaatatttcatctgaatattttgaaggtgtagtgtacctcaatggcatatctgctggtgatcgtgtcgctattatagatgatacgttgagtacagggggtacggttatcgctctcattaaagcaatacagaattctggaggaatagttaaagatgttatttgtgctgtagaaaaaatccaaaacaatggtaaaaaaaacatatttacacaaacaggcattaacgttaaaacactaatgaaaattagtgttaaacctcatggggtagatatcattgagtgaaattcaaaaatcacatctctccaacaattactggttaaaaaaacacattatataaaattaatcagtgagataaggaagtactatgcatgcttatagtggaataagttacggcgttattttttgtctgatcagtgcggccttcgatgtctatgttggttatatcactcaatcaataagtccagctgttattattctctactgctttatatcatctacaatagtctttcttctattcagtatattaaaacagggcattgctgttttttataaagccaaagccaatctaccattactgctcttggctaacgttgccgtgttactgaattggggtgggcttattgtctcactgcgctatcttgaacccgctattgtcgggatagcatcggttgcctgtgggccagcaatcaccacgattatctcccgatgtatagataataggagtggcaaaaatagcgggttggagttcattatttcttggctaattatggttggtgtcatcctgatgttatgtaactcgctgatgggaaaaagcggcgttacgaccacaacggtagatgaacgtctcatcggaattatatgcgtcatcctcagtgcgttaggcacggttatctatacctttatctctcgtgagttataccagcggcagtgggaaacctatgagatattagggtttagaaatatgctgatgctactgattgcggtgatttattgtttttatgctgatatcccattgagcattaatatgaaccttgccgcaccaatggtacttctggtagttattggtcacttgcttccaatttacctgattcaaaacactataaaacgcttacaacctctgcacgtgtcgctggtattgctactgctccccgttttcactcttctcctacaatattttgataccagagttgaaatttccttcgacagcattgccgccgttagcattattgccattctgttatttattctcggcataaacaaaattattgggaacccaaaaacaaaaggggcataacatgaaaaaaatcattgttgtagacggattttcttccggtaaatttgtggctatgacgctctataaaatggggtgtgaacttattcatatcgcatcgcgctgtgatttggatagttattactatgcaggcttcgatgaaacaatctatcgtcagcaacgcatcaataagcacattgatgacactatcgaatttgcacgccaacttggtgccgacgcggttattgcaggggcagagagtggtgtcctgctggctgatcggcttaatcatgaactgggtttatgctatagaaatgcctttgtcacctcgtctgcccgtcgtaataaatatgagatgatcaatacattggctaacgcaggattatctgctgccagacagattgataccgctgactgggaggatgccagcgcatggctggacgttcacgcaacatggcctgtcgtcttaaaaccacttgagagcgcaggctcagatggtgtctttatttgccaagataagcagagtgcgtatcacgcttttttggctattctcggtaccgcgaataaactcagtctggtcaatgaaagtgtattattgcaggagtttcttgatggcaccgaatacgttgtcaatttcgtttcgttagatggtgaaccgttggtcactgagatcgttcgctaccataaaagaaggctcccatcaggcagcgtcatttacgatattgacgaacttctcgattgtacaagcccggagtatcagcctctggtggattacaccaaacaagccgctttggttctggggatcaaaaatggccctagccatgcggaggtgatgatgacctccggtggcccggttctggttgagattgccgccagaactgatgggattttacaccctgacgtcgccgccgtaacaaccggctttggccaactggtagccttcgcccaatcgcttgctgatcctgacagattcaggcaaacactcaaaaaagagagttatcggctaaatgctcattctttcaacgtgtgcttgatcaatcaggccgctggaatgttctcagccaaacattttgaacgtgaattacaacgcctgccctcatataaaaagtcagtttattacgtcaatgagggggacaatattaaagtaacaaaaaatgtattcagccaaccaggaacagtttatttggtccataaaagcaaagaacagctctggcaagattatacctctatcaggaaaatggaatctgatggattctatctactgccataagtaatcaaaaactgatatctcattcgtccttgatgttagacacagcgatacggtcatagacacagcaatgcggatatctgcatagtaaagtgggtagataaggcaacgtggcataaatacagttgcgcagtttattgcgcaaagtatgaacgcataaactcacatatcaggcaccgatatctcgctatttttacctgaaagcgtaatagcttgatgatcatgatgagtctctacatcaagaagataggaaaattcataatttatccataatgttgaagcaacatcattaacacaggtggtttgtttttatttttaataaaatacaataggttaaatcaaaactttccgtgtattaaccccacgaaatgtgtttaatcctgctctggcgctgccaattcagtaaaagggcaaattacgttatctgttcatcacaagcattgataggtatcatcttgggattggtaataaaaatcattagcattactgatgctgatttctgcattccacttctcaggagagaaaatgcgattacgtttagctttattttcgtcattactggcggcaacctttgcgataacaggctgtgatcaatcgtcagaaacccctgacaatgcagcaacaatcagtattgaacatgcacagggaacaacgctggttccgctaaacccacaaaaagtcgtcatactgaacccatcagtgctggataacgctgacgccctacacatcaaggtagccggtgttccacagaccagcacacatctaccagcctttttatctaagtacagcggccctgagtatatgaataccgggacactgtttgaacccgattatgaagcactcagtcaggctaaacctgacctgatcatcgcgggtgggcgtgctcaagatgcttataacaaactcagtgctatcgctccaactatcgcgcttgatgttgatactcagcactttacccagagccttacccagcgtactgagcaactggcctcaatatttggcaaagaagaagaagccaaaacactgcttggtaatttctcatcacaggtaaacgcgataaagcagaaatcggctaacgctggctcggcaatggtattgatgatcagcggtggaaaaatgtcggcttacacccccggttcccgttttggttttatttttgacgaactgggattcacacctgcggccacctttgctgaatcaggccgccacggaaatgtggtgacatcagaattcattcttaatgctaatcctgactggctgttcgtccttgaccgcgacaatgcgattggccggactgaagggcaatccgcacaacaggtcctcgataacccgctgatccataaaactaaagcatggcaaaacgatcgcattgtttatctcgattctgcctcactctatattgccgggggtgtgcaaagttatacacaactgatgaataaggtgagcgcaatactggataagccagtatcagagcagtaactttcatccatgaaaaatttaagctttgtcgcaggcctggtgatcctactgggcctgatgatatgcagcctattcatcggggccgggcatgttacgttcgctaatctctggtcggatcccgatatgcgcgacatcttcttcatcagtcgtgtgccgcgaacgctggcattggttctggctggcagtgccatgagcgtttccgggctgattatgcagatgctgacacagaatcgcttcgttgagccctcgattgctggtaccacacaatcggccagtcttggcttattgttggtgatggttttcagtccatcagcctcggtgatgatcaagatgctagtggccacgttattcgcgatgggtggcaccgtcctgttcatgatgttattggcacgcatgagaatgaaatctgcgctgatggtgccactgaccggcattatgttaggggcagtttttagtgccgtaaccacattcctggcgatggaattcgacctattacagtcgttaggcagttgggagtccggtgatttttctggtgtattacagggccgctatgaattgctgtggattgtgggcgtcctgacgctggtagcgtgttttatcgctgaccgcttcacggttgcgggtatgggccaggatttctcggtcaatgtcggcttgaattatcaaagagttatgttgattgggatgtccatcattgccatcatcagtggcgtcgtggtagtcgtgattggtgtgctgccttttcttggtttgattatccctaatattgttagtatggcgatgggcgataatctgcgccgaaccataccttgggttggcctttgtggtggcggcttggttgtattatgcgacattattggccgattaatcagttacccttttgaaatccctgccagtgttattctgggcgttattggcgcactcgttttcctgttattaattgttaggacaaaacgtcatgcgggctgaggagtactctgcaaaaaacacgctattccaaggcataaataaagcgttaactttgccagcaaagcggttattgctactgagcatcatcgctctcggtgcgatgattattttcatgacaatcaatctgagtggcaatattcagtatattctcgttcatcgaggccttattttagccactatgctgttggtcgctttcgcatccggtgtggctacggtcttatttcaaacggtaaccaataatcgtattttaacgccatcagtcatggggcttgaggcgctatttattctgatccagacgatgttgatattttttattgacgccaatgggttccgcgcattaggtatcaccggtaaatttctctgtgaatccgcattactgttgctgttctccgttttcctttaccgttggttactgtctggtgtaggtgtcaatctgcacaaagtccttttggtcgggttagtttgtggcacactgtttcgcagtatctctaacctcatgcagcgtcttctttctcccggtgaatttgccatccttcagggccggatcttcgctacgtttacccgcgccgcaccagaaattattgccgtctctgctgggatcatcgtaatggtgggcgttgttatttggcgtcagcgtcattgccttgatgttatttctcttggcagaaataccgcgattaaccttggtgtcgcgtatcagaaaaaaataaccgttatcctcctgttggtctcactactggtcgccatatcaaccgcattggtggggccgctgaccttcttagggttacttattgcgaacctggcttatccgattgtgggctcataccgacatcaatatttactaccaggggttttcctactgggggtgattacactggtcggtgggcaattgatccttgaacgtgtgctgaatatggcgggaacactgtccgtcgttattgagtttgttggcggcgcactgtttatttatcttttaataaaaaaggctcccgtgtgattgaaataaatgatgttaataaaaaataccaacagacaacggtactcaatgaaatcaatgagcgcattccctctggtggtattacctcaatcattgggccaaatggtgcaggaaagtctacgttattatcgattatgagccgcctccttactgccgattctggaaatgtgttgttcaatgggctggatgtggcaaaaacctctggggataagctggcgacaatcctttccgttttacggcaagagaaccattttaccagccgcctgaccgtctctgatttggtaggttttggccgttatccctactcacgaggccggctcaacgaaaatgatcgccagcatattgatgctgcgatggagtttctcaacctgatgcccctgaaagatcgttatcttgatgagctctctggtgggcaacggcagcgcgcttatgttgccatggtactttgtcaggatacgagctatatcctgctagatgagccattgaataatttagacatgaaacattgtgtcgcgatgatgaaacaattgcggcgggccgcagatgagctacataaaaccatcattctggttatccacgatattaattttgcctctgcttattccgaccatattattgccatgaaaaatggtgaggtcatttatcgcggagcaccagcagaaattatgcagccttcgatcctcgaagaaatttttgatataaaaataagcatagaaaaagtacaaggccagcatatcgcggtttattatcgctaaggtgtttgcctgtcatcaacttcactttgacttaaatagttcttcgcaatgattacatcacttttacggactgcattacctttaaaactggtcagccccatattcggtaagttggcatcagctcgttggtggataagctctgcggctgtttgcccggtacaggcaaagtgtaatttgttctgaataacgtggaaaaaacgggtcgtctcttgcaatgaaggctcatagtcggcagctaaagcaaagatctctcgaacccgcagataaacccgtcgctcactagcacggatatcgcggatacgttccaacatctcgccaaagtaatcaggcattacagactggccaacaggcgggttcttcagccgctcatcatccatcacaaaacctttaatcagatattcctgcaaagtttgtgtagcccactggaggaactgagtctcacgaaccgaacgaacccgataacccacagcaagtattaccaataagctgtaatgcatcgtgtttcgatttacttgccgagtccctttggcgaacttgtaagaaaggcttacaggttgcactttgctcaagttcgccgtcttcgtagatagccttaatatgctgcgtgatcgcctgaggcgtaacttgatagagatttgctattgctgcctgagggagccaaagagtttcactttcaaaacggcattcaatacgaagttggccatcctcagtggaaaacatcacaaattcaccggtaggggcctgaggtaagttttcgtcagtcatgctatctccgtttttatcttgctcatccgtaagttttttcatatttaacatttttacccgaaacagtgatgtttctggatattttccttcctggagttctgacttggagctgcattgggatctgtgtcgttctacccgcgttataatcctctaaggccttgccctgagtgactttcacgttgagttttttgaacgtttcctccacaacagtttcaaatggtgcggctactgtccttttccccgcaaatcggttaaatcgagtttttgcatacacgccaaggctaacccgaattaatacgccctctttaacgagttcagacaatgctttgctaacttgcgatttgctacccaagtgttccagctccgaacgcagtacaacaatacctttccggttggcgatggagcgcaacagtttttgcttcaaaagcatgattgccccctttaagaaaccataggtaaaccaatgtttattttagattatttttaatttaaaacaataagttgccgtaaaaaagtaagattataaatgagcatctatatcctgttaaccatcaagagattagtacgttaagtgctcaaatgaagtgagatggagtgattattaatctttaaaggcatcgcacgatgcctttttacatttaggggttattcggcctcaagaggctcactggtggcttgatgataagtttgatgtagctagtctatttgctgttgtaggacaaagttgagtatttcttttgcaacgggcctcggcaagagaaacaagatcataagtccctaatgacattaatcgggctttaccggcaaaacgatagcgaaagcgccaccctttgctgccgttaggttcaattaagagtgatagcccttgcccgtcactcagggtataggctttttcttgtggtttagcacggcgaatctgtctatctgatagtggcatgtgtatagctcaaaaatcaccataaaatcctatacacattgctatacacatttgttgcagatttgaggagatcaactcggaacaccacagacagtaagtgaaattataatgatgatatataatgattttttagactatcttggcagtgtatggaaaatatgtggcgatcacaggagtcgcactggatgattagtatcatgatattaaaggaattatttaatatggacaattaagtaacccccataagaacccccaaatgcttttgcttgcttctttttgtataaaaaacaggcaataaataactcatggatattgcagattttactccatttttgatgcagtaaacaggctcacttatcgcttcaaaatgaatagagggcacactcttctcgagctaacatccctggatagtgcttcgccacgatatcgttcattttctccaccagatccaagcgtttgaaaattacatgcgcagtacctttttgaaaatagcggataccaaacagctcatcctcgtaactctgttgacgagggttatctcggatatactccattaaccgcacagagatatccccacgattgtcaggaacgggcttaccatccaacagatacaacattcgctccaaatcaactaactggtcccgccgccagccccaacttaagctgaacccccaacggttatgcgtgaccagattgttaacaatgatttttttgccgaacatacagggattatttgttttatatttccatgataatcccctgaaaacattgataacaccgcgctcaaatacatcctgtttattcagatgtagctgttcaaaagtgctgaagatattgtcttcattgatagctggtaggtcgccctcttccaaatttttataccactgctcgcgagcttcagcatccatgagagctagcatgccagatttcaccatcagatcacgccaaatactgcgatcgatatttcgggtgatcaactccatagctttatctggtacttccattaaccagcagtcatagcggcttccctgtctcatcgcccactcgccagcagtccccccaccaattgaagacgtaagtgaagaaatgttactgagctgatggattagctgctctatccgtatcagagcactatcgcgaccagcaacgattcgcgctacgctggtcgaacaaatcacctcgctatgatcaaccattacttcgggttcagtttgcatcatcgtaatccttacataaaagcaaacacgcctgccaagtcagttagacgcattatgcaacagataaaaagggggtaaagctcaggacagatattgtggaaagcgtttcgcaaaacctagatgactaatagctttattgcctatcgaatgcgaacttgccctcaaaaaaaaatctgccaatctgggtggacgggtaatcagcatgccagcagtaatccggacaggctcatgtctgcttttcgccccggataactgagatgatggtctggtaacccagacgggtcatcaggccggtggctcgacgggcacggagaatatcgatagccgtgatgaagggagattgttcctggcaggagaacccccggcgatcgatacgaaccaggccaaacttttccaccgtgaaattcaacgcatcggacagagagataccagcatcaatatattcgtggatcacggcgtcatcactgaactcggtatcgttaagagccaatccgtaatgctgttccagcagatacgtgagcatggattgccagacaacaacgggtgatgggcaagcataagccgcccgtttcggagtaacaggtaagatctgcatatgggttatctcgtagttagctagatgatcgatagaaataaaaggcgaagatttatgcagttgattggggagtaggataaatagcgagatacacataaccgtgtgatcccaggctatcggcctcacaggtcaagccattgcgatacaacgtgacacagtgctggtggcgagggttgagctcaccggagagcagcatcagttccaggtagttgatgaactgcgggaaggcgttatctaaatcacgtacctgcacttcgctgaaggttccgttgatatcggcacggtcggctagaaaatgtagtcggtcgccttcctgtaccagacgggcaccaaactgcggagtgacgttgcgtttaagtccccaggctggggtagtgattgatggcatcgtgcctccccctataacaagccgtgctcagcaaacgaatacaccgtcatgccgccgacaatacagtgatccagcatcctgacctcaaccagtgccagtgcatctttaatcttgccggtgatttgccggtcggcaacactgggctcagcgtggccggagggatggcaatgcgccagaagcaccgctgcagcattgtgttgcagtgccgctttcacgatttcgcgggggtggacctcggtactgttgatactgccggtgaacaacgtttcgtgggccaacagcctgtgttgattgtcgagccagagcaccataaacacttcacgatccagtctagccattcgcaatcgcagccaatcgctgacggtaccgagtgaagtgaatgaggtccccggttcacgcagatgtgcttccagcaagaacagagcacgtttgacagtacgctgcgtacttaatggtagttcagtgaccaccggggataaggttaagttcatgaagtttttcccgttgttttcagtcgttcatatgcatgatggcgctgtattcaggactcattgagcagtagcgcaggaaactgcttgaaataggtcatctcggctccttaatacaaaaagccccatcgcgatcagcgacagagctcgaagtgagtagtagaatgatggcgttattcaattagctattggtgatcaacaaggcgcttgagtggtgataactgactattgcctgatttgatgtcgcatgatgtagccttagcatcaaccaatgccttcccaagagctggggccagcaatttcgcagggtattggaagctgtacgccagagggacatgatcgaagctgctgtcattatggtagaagtgaaaaacaaaggttccagtcttgtgatccagcatttttgaaacagcctttgccaaattggctgtcagcagactatccatcagcgtttcgggatgatcgatactgatgttcatttgatgagcccctgccgggtaatactgcagggtcattcccgttgccccatcagccttatcaccatagatatctttcaggtaatacaggatattcaaacgcgcttcatcagcgttgcaggtgagcctgaatttctccgtaatctcccctttcctgccagtgatgataaattcatcaacgccatccataatacggtcatgctcaacctgtacgttgtcagccacctcattccggtattctatcggcttgggatcataagccgctgcgcatacggcctggctcaacagagcgctgaccaacagggtaaacaccattaacatttttttcatgttcatcatctccttgataaaaatcacttattccgaatctgtgagcgtgacgtaaatattcccgcctgagcgcacttctatcgtcagcggctcttttgagccggtattcagcaaagcctgagcctgataaaaacgccctgccacctcctccttgatatctgtgatacggatacagtgctcctcgataccctgacgctgcaggattttagtcaccaccggacaggcactttgcgccagccgttcggtacccgattgcgttttaaaatgattaccagccacggctgataacacggtgcaaatcagccatacctgtaacaagcgccagagcttcccctgacgctcgtcacgttgacggagataaactatcggaagcaagaaccatcccattgaagggggcgtgatctcctgcttcatcaggttaagtcggtcgagcaacacccaaataagcgagagcaccatatacaagccaagggcaatctctgtaggaaagaaaatggcgaagggtatccagataaccggaaggccaatggacaaacaccaggcgtaggtgtcttgcttaagaaacggataaggtttcaacatagagaaatattcctttattaataattaattagaaaaaattgggattagacgacctccccagcgaggggatcgtatcgggatgtaaagaggagggataatcgttagtgaagatcaataaaccgaaaccgatcgttgaaatctatcgatataaacgatcattaataattaattaatagtcaaaacctataacaaacttgtgttcgatcggcgaaacagatcgaacgcatgacaggtttctagacatacgttaaaagaagcgatgccagagcaatttggctaaagagagcagtcgatagcggacctgttttaaccactttcttaatgtgtgtgactccaacagggcttccacgctgtcgtcaaagatatcgcctacaacgcggctaaagccctcctgtgccatggtggtcaccttctccgtccgatactcaggctcaagctgacgggtaaccgcactgctggctttgtcgggtaaaacggcgattagggtttcgacccaccgaggtatattgaaaccttcagaggcagaaaccgccgagacaggatgaacaggagaaaatatggtattcaccagagttactttctcctgcaggttctgctgctgccgcagagaaggttggtgggttgcagtatcccattctcggcaaggctctattttatcggcctggctgaggacgaacagaaaatgggcgggatttgcaccctgtgaaaccaactgccgataacaccggatatcgtcattccaggcacgatcatcagctttcagcacccagacaatcagatccagcttattcagcttattcagcttattcagccaatgttggtacaagcgggcatacatcttatcaagcgtgggtgtttcaccgatccctgtcaacgccacgctctttgaccgttatttgccattttcatgcccgctagatgctttctttactgatgctgtccgctttccgccatttcatcgtcactgattggcgttgcgtttttggccagcactccagatttgcgtttctcctttaaccggtagctttctcctttgatattcagcgtggttgagtgatgcagcagccgatccaggatcgccgttgccaacacgttatctccgaacatctctccccagtctgcgaagcctttatttgacgtcaggatgatgctcgctttttcataccgacggttcagtagccggaagaacaggctggcttcctctctggtcattggcagataactgagtatgtctgtaaaaaaggaaggctgtaccatcaccagtgatggtctggcagaagccaaaaatggattgagcaggagtggtttaatgagcgctccctgtttttcagaaaacaaagttttattttatgttctgaattgataaccctggagtaaaagctaagcagcaaaaaatatatcagagcgccccctacaaggaactataaagtaattggcaccaatttaaatatagtatatataagatatataggaatgggtaattaaacataagaaagacaaccaataaaaaagaaataaattaaattcaatcatactcaccatgttgattataacatttcacacccattataaaagacacagtgaaatataattaacgggccactacaaacaccgtaaatagtaaaacaacagcctacagttcataataaggtattaaagcgtgatgagcaccaatcactaaagccacctctattcagtataaaataaatatcaaccagcaagagcattcattgtcaagtttcacattagcgacagttgatacagaccctacggcaccatgcctttctacctaattacaccttaattctcattcgtgcacccatcactgccatttgctctggcagagcctgcgcacgtctgaaatatacccacaggagcaatcttaatgaccagcagtaaatttggccccttgaaccctgactatatgaatcgtattactgaaatcatcaacaaagcaacaaaagcccacgccagaacatccgttttcaccttcgtactcagactgcctgagtaccgcgatacaggtgacagtattgcctgtgaccctaatctgaagaccggagtaatggaacgcttcacaggggcgctgagggcgcgtatagcagcccatcagcaacgacgtaaacgggaaaagtctcaggtatgtccaacggacctgagatacgcctgggtacgtgaggtggggagcagctgtaaatctcactatcacgcagcgatattcgttaacaaatatactttcaatgggttaggggattattcgaaggaagaccataatctggggagctacatctgcgaggtctggctaagtgcattaggtctactcgatttccctgagtaccgaacgctggtttccttcaacaacacgccacactatctggagagtcttcgggtggaccgctttgggcaacagtaccttggattacgtagacacttgagctactttgccaaagaacacaccaaggtttatgacaaggaagaacgctcattcgggggaagtgtcagataagccaacagagcgtaggggatacattctctcctgcagtgatgaagttcattttcctcctcttcagggtcatcctagaggcattcaactcgagtcgaccattcagaagcacaaagaccagcactcaaagaaaaatctttccaaacaaatagccggagctgtcactccggctcggattcactcattactcaaagtaatccatatctagtttgggcactttaaccaaacgggaagaaacaccgacttcgttctcaatcatcaaatgaaccaggcgttcaccatcaaccaaaaccatgccctcaacggaatgggaaaaatctcgcgcctgagaagtaaaaccggaagtggtgataaacacgccacgtttggccttttgtcccgccagcgcaccataaaacgcctggagttccggacggccaactgtgttctgccagcgtttagcctgtacgtaaaccttttcgagtcccagtttatcaagcgagatgataccgtcaatgccaccatcaccggtgccacccacgcgttgtaggtcatcccgatgtccaccatatcccagacgatgaagaacatccaggacgataacctcaaaacgtgccggggagacttgcaacagattttctaacagctcatcagcaaccgcgtcccgtagctcttttaacgcctgatcaagtcgatcatccgggctgctttttgccagctcttcctgattcagtaccgctggtcttggatcaagatcgacagcatctggctgctgttttagcttcacgttcatgaaattaaacgccagatggttcacttccctgtaacgaacggtgcaatagtgatccacacccaacgcctgaaatcagatccagggggtaatctgctctcctgattcaggagagtttatggtcacttttgagacagttatggaaattaaaatcctgcacaagcagggaatgagtagccgggcgattgccagagaactggggatctcccgcaataccgttaaacgttatttgcaggcaaaatctgagccgccaaaatatacgccgcgacctgctgttgcttcactcctggatgaataccgggattatattcgtcaacgcatcgccgatgctcatccttacaaaatcccggcaacggtaatcgctcgcgagatcagagaccagggatatcgtggcggaatgaccattctcagggcattcattcgttctctctcggttcctcaggagcaggagcctgccgttcggttcgaaactgaacccggacgacagatgcaggttgactggggcactatgcgtaatggtcgctcaccgcttcacgtgttcgttgctgttctcggatacagccgaatgctgtacatcgaattcactgacaatatgcgttatgacacgctggagacctgccatcgtaatgcgttccgcttctttggtggtgtgccgcgcgaagtgttgtatgacaatatgaaaactgtggttctgcaacgtgacgcatatcagaccggtcagcaccggttccatccttcgctgtggcagttcggcaaggagatgggcttctctccccgactgtgtcgccccttcagggcacagactaaaggtaaggtggaacggatggtgcagtacacccgtaacagtttttacatcccactaatgactcgcctgcgcccgatggggatcactgtcgatgttgaaacagccaaccgccacggtctgcgctggctgcacgatgtcgctaaccaacgaaagcatgaaacaatccaggcccgtccctgcgatcgctggctcgaagagcagcagtccatgctggcactgcctccggagaaaaaagagtatgacgtgcatcttgatgaaaatctggtgaacttcgacaaacaccccctgcatcatccactctccatctacgactcattctgcagaggagtggcgtgatgatggaactgcaacatcaacgactgatggcgctcgccgggcagttgcaactggaaagccttataagcgcagcgcctgcgctgtcacaacaggcagtagaccaggaatggagttatatggacttcctggagcatctgcttcatgaagaaaaactggcacgtcatcaacgtaaacaggcgatgtatacccgaatggcagccttcccggcggtgaaaacgttcgaagagtatgacttcacattcgccaccggagcaccgcagaagcaactccagtcgttacgctcactcagcttcatagaacgtaatgaaaatatcgtattactggggccatcaggtgtggggaaaacccatctggcaatagcgatgggctatgaagcagtccgtgcaggtatcaaagttcgcttcacaacagcagcagatctgttacttcagttatctacggcacaacgtcagggccgttataaaacgacgcttcagcgtggagtaatggccccccgcctgctcatcattgatgaaataggctatctgccgttcagtcaggaagaagcaaagctgttcttccaggtcatcgctaaacgttacgaaaagagcgcaatgatcctgacatccaatctgccgttcgggcagtgggatcaaacgttcgccggtgatgcagcactgacctcagcgatgctggaccgtatcttacaccactcacatgtcgttcaaatcaaaggagaaagctatcgactcagacagaaacgaaaggccggggttatagcagaagctaatcctgagtaaaacggtggatcaatattgggccgttggtggagatataagtggatcacttttcatccgtcgttgacacttccccgtcagtgagtggctgggtatgggcatgtacccaattaaccccttctggcgttaagcaccactttcctctggataagctttgcgataaaccggctcgcttcaggcggtcatgtgcccaaccagcccgatttttataaactaactgaccgctggcaatcacttctgcccgctgattatcatcaagattaagtgcatcagcagcggcttcgtgcgcatcgcgagccggtacgccattgggtttatcagccaaatagcgtagcaatggctcaataaatttatcgtaggtaggaacagccatagaaacatccctgataatgtttttattgaataggttggtagcttagcaaccaagtgtacttccagctcgtgatgaagatgtatatgtacaccactgttaccaatttaactgactaaggtaaacctcatctccacatcataaatcggaaaatatcatccccgccatcccatccaatcgtttcttggtcttctcccagtccggcataacctgtcccatgagccggtagaagcgttcactatggttatgctcggccagatggcaaagctcatgcaagataacgtaatcgatgcactcccggggggctttcaccaggttgggattcagagtcaccctcccattgggggaacaacttccccactgagtctgcatggaaagaattcgcaatggaggtgagtcactgacccataacgcttgctccagcattgcactcaaccgtctggcgaatacttcccgggcacgggccttataccagtcagtcaacaactgcaggaccttttcagcactcttatggcgtaaagtgacttccagcttaccgcgcaacatttttacgccctgaacttcagagggagccactatcaccttaagcatgtactgtttgcccaggtaatagtggctctcgccactgatatactgtcgtggcgtgatatattccagctgcttacggaaatccctcaactgctgatagatccaacgcccacgcttttcaacagcattcagaatctgttggtcatcggtatcctgcggcgcggataccacaacccggcagtcagggtgaacttttatcagaatgcgcccattcaccaacggtcggggcttacgctcgaaggtaatgcgttcatcaccgtaaatgaagctcattgctctttcgcccacgatttacactccgctcagccctacacgggtaatctggacaatcatttccacaatttttttcgcctgatccatcccgccaccaattgccttacactctttaaacatcatcggtagaagcttcttgcggatatcagcctcgatattttgcggattgatcgagttctcagccacagagatatcaacagcctggtctacttcaaaagcaagcttcacccatttatcgatgacctgagaatcggtaacggcaaaaacctccggcagcacttttttgtacactccgaagtaagcctgcgcatggtgattaccagcaaagacgtcgggtatttcgttcagccgccgatcctgtacttgttcctcaaactcacgaaatagtatgtactgcttgagagggtgatcaaacagtttttccgcctcttcaatagccagacgcaataacttcgagaaggcttcctgggcataaggatcatcacgtaaatcctgctcaatcatgcgggttacgcgggttttgataatatccgtttcgttgcgggttttatcctcactccactcttcgggccgttgtcccattttgctgacttcatacactccgtcaggctcgcggacttctacgccaacaacgtgtttatccagcagctttttaacctgttcagtgtactgatcataatctaccgtctcaccggcatcctgcttcaccaactggcgcaagctggtaaattgcctcagcgtctctttatagtgctggcggtcttcttcactgaaactcttatcctcaaagaaggtagccgactgcaacgccactttcaggcagctggcaaattgcgtgagtgcttcatagaagtcttcgcgaactttaagatgaacatcaaccatttcgccgtacttttcttccgtgcgcggcaccaatacctgacgcagctgctcaatatcgtttttattttttacaccagcgaaaatcgcccacaaatttttatacagctggggaaggcgcttgtactccgtactcatctggccgtacagccccaccaagtcatcaatatcaaatccgccctgcgtgcgggatgccagcttctggtaatcctcaatggtggtatccagctctttgaggatgccccgataatcgattaacagaccaaatttcttcttgggatggaggcggttaacgcgggcgattgcctgaatcaggttatgccctttaagcggcttatcgatgtaaagcacggcatttttgggttcatcaaaaccggtaagtaacttatcaaccacaatcagtagcttcagcgaatcatctttatcaaaacgatcgatgacattgcgcgtataaacctgctcatcctgagagccgacattatcttgccaccatttggtcacatcagggataccagattcatccacctcggtattcccttcacgcgtgtcaggcgaactaatcaccactgcagactcaaacaacccggcttcatcaagatactttttgtattttatcgctgctgctttactgtcacaggcgagttgccccttcaaaccatcatcgatgtttttgacaaaatggttggcgatatccagtgcaataaggtggatgcgatcgtcagcattatagacctgccctttattagcaaacttacgcttcaaatccgccttttgtttatctgttaacccttcagtgatacggtcaaaccagctatctatcgctcgttcattaacgttcagctcgggcgggcgctcctcgtaaagaagcggagtaacggtcttgtcctccaccgcacgctgcatggtgtaagcatgaacgatggggccaaatttattcgtggtcttatcatctttcagcaacggcgtaccggtaaaagcaacaaaggccgcgttgggcagagccagcttcatgcgttgatgactctcaccgccatggctacggtggccttcatcaatcagcacaatgatatcagagctggtattcacgcactcgggcaggcgggtggccgtgttaaatttctgaattaacgagaagagaatacgctcagtacccctgccaatctgttcggctaaccgtctgccagaggtggcaatggcatcggctttatcccttttacctgccagttccccggttgagataaaggtgcgactaagctggttttccaaatcgacgcgatcggttaccacgatgatgcgacactgcttgagagtttcactcagaatcagcgccttgctgaggaaaaccatcgtcagcgacttacctgaacccgtggtatgccagataaccccaccgttgcggctaccatcaggattcttcgtttcgatacgctgtagcagtcgtttgatactgaatacctgctgatatcgggcaatgaccttaccggctctcttatcaaacaatgtgaagaagcgagccatatccagcaggcgctcgggtaacagcaggcttataagcagctgatcctggcccgttaaagctagctcgccccctgtgatcaggttctgataccattccaggcatgcaaccgggcggtgcctgaagattgaatccatctgctgcgcgttaagtttgcggttttttatggtaagcatctccagatcggagatatcttcttcccgccatgtcgcccaaaacttggctggtgttccgcaagtcccgtaacgtccatcatggccgtttatcgacagtaagatctggctgtaggcaaacagtcgcggaatttcatcatggcgctggttgcgcagactttgagatatcccttcgtcaatagttggcccttttttagcattgccatccgggcgcttagcctcgatgactaccaacggaataccattcacaaagcagacaatatcgggcctgcgcgcctcaataccattagcgcgtgtcacgctgaattcttcggtgaaaacaaagctgttgttcttcgggttgttccagtcgatcagcgatatagttgggttcgcccgtttgccatcgataaactccgtcactgagatgccgtacaacaggtggttgtacaagtgctcattggcggtaatcaatccctggtttaatgccggactgttaacttcggcaatcaggctatcaatcgctttgtcagaaatggcatgctctttaccggcaaagataaacgtcctcttggctaactgttcacgcaaaatctggtttaggaccacctgatctaccttgcctgctcgcgcagacaaggcttgctgaggtgaaatataggtccagcctaaattgctcaagagagccagcgccgggagcttggcgctgtactcttcctggaattttggcgcgatttgcatgctcatgatgttcccttatctttatcggctttccagtgcagtagctcggtaatatccttttcaccctccgcctcttttaacaaacgccgctgctctgcaaatcgtgcatattcaccctgagctttttcatctgccattttcttactgacagtgcccgcgccctgtaacacattgcggtcgttgaactgcaggaattgatccagcttctcctgccagtcctgcaaaaaaacctgctgacgtcgcagcgcctgatcttcggcatagtccagccacatattcactacacggttcagctcactgacctctttttgggtcagataattcttagcaaccgtgacatcgccttttcgcacgtcattgcctttatagctggtgagccccatatgaggctggctggcatctgcccgctggtggattagctcagcggctgtacgcccagtgcaggcaaagtgcagcttgttctggatggtttgaaagaagagggtggtctctttcagggacggctgataatcagcagccagcgcgaaaatctcccgcacacgcagatagacgcgccgttcgctggcacgaatatcgcggatacgttccagcatctcgtcaaagtagtcgggcaccacagatgagccaacgggcggattcttcagccgctcgtcatccattacaaaccctttaatcaggtattcctgcagggtttgcgtggcccactggcggaactgagtcccccgaactgagcgaacacgatagcctacggccaatatggcttcgaggctgtagtgctctatctctctggaaacctgacgttttccttcctggcgaactatccggaatttccggatagttgaattttgaccaagctcgccttctgaaaagatgttgatcaggtgctcgttgatggtacgaacatccttatcatatagctcagccatggatgcctgagtgagccaaagcgtgtctgactgaaagcgacactcaacgcgtgcgcggccatcctcgctttgaaacagcaggaattcacctgctggtggttgaggtaagtgtttatcagtcatgcggcgtccaccttaacccggcgtttaccggtgagcagttgctgcatcagggcttttttttcttgttttaggtgattgagtttttgttttagtgttgcgatttcctggtctgaaacagttaaaacagttgcaattttattctgttctgtaaatgagataggtactgtgagtttgagtgatttaagataatctgttgttactcgtttttgaccagcagaaccctgcatattcatttcacctctcaccctgaactccgtcatcacagtaagatagtaaatatattttgcgttaaccccttctttagccctcagtacatgaaattctgtactaccaaaaccaataccattggttaaattaattacataagcacctttcccattttcaaagcacggagtaatcttcgcgactaacacatcatcatctttgaaggatgtaaaaccttttgaaacatccgaataatatctgtcttcagtttttattaatttcgcatcctctgatacgccgtccatagagatgaaagaaacaaccccattttctggtttttctgatcgactgggatttatgaagcataagtcagaaagatgaacttccgtccactcttcactaaacccaggaaaacgtttcttaccagtgagcaattgctgcataagtgcttttttctgcagctggctattggcaagcagttgttcagtggtagcgatcgccttatcccaggtagaaaggattctggcgatctttttttgctcattaatcggagggagaagaaaagtgaaatcttttatatcattaggacttatatgaggcacagccgtagctgtttgaacagactttacatactgttcaaacttattatcagaaaaatattgtctcagaagtgactgttctaaggttgaacgtgctcgtattctagcgacgcgctgaaccagtagacatggtatatcagtatgttggacttcagcgacttttaatcctgaagaaacccatgtacgatccattgcgatcacaaagtctccttttcttaattgaaacttttcaagtttctcatactcttgagcaggccaaaattttgcatctctccatctgagacgagatggctcaatattatctccccttagtagtctaatatcctcaggattgttagaataactcttgcttttaaaagcaaaacccgtgagacaatcgacatggttaccaaatgttgataacttccacccctcaggcaccataacccaactccctcagatactttgtcatctccacttccagatcggccagctgtgcttgcagttgcttacgctcggcacgggccgtcatcaggtcaatttccgtttcttcttcaaatgtatcaacatagcggggaatatttaggttatagtcgttgtcgcggatctcctgcagactggcaagataagcatatttttcgacgttatcgccatcacgataggttttaacaattttggcaatattttcagtacttagctggttttgatttttacctgagttaaactcacgactggcatcgataaacaacacgttatcgtccactttactctttttaaatatcaggattgccgcaggtatacctgtaccgaaaaacagcttttctggcaaaccaatcaccgcatcgagaagattttcgtctatcaacttctgccgaatttttccttcgctagaaccacggaacaacacgccatgaggaaccaccacccccatacgtccagtctttggcttcatggtttcgatcatatgcaggataaacgcatagtcgcccttggttttaggcggtaggccacgacgaaaacgactgaactggtcgtcagaaacgtcatcaattccccacttttccagtgagaaaggtgggttggcggtgaccacatcaaacagcatcagattggcatttttatcgagtagcttggggttgcggatcgtatcaccccactcgatcttgtggttatcctcgccgtgcagaaacatgttcattttagccagagaccaggttgaaccaatcgcttcctgcccataaagctcgtaattcttactatggtatttctcagcaacccacttaccacacttcatcaatagtgaagcagagccacaggttgggtcacagatagattcccctggctgtgggtcaagcaacgccgcgagcagatctgacacttcgggtggcgtatagtactctccggctttctggccgctgttcgcagcaaacttgccgatcaaatattcataagcgttaccaattacatccaagccaccaacacggcttggtttcaaattcagctctggatgagtaaaatcttcgagtaactgcttcaagatcagattcttttgcttttcatcaccaagcttattggtattaaatgaaatttcctggaacacgctcttactaccatctttcagcttagtgccattagcttcttcaattgcgtgtagagctacatcgatacgttcaccgttacccgcctcacttcgacgcttataaagagcataaaagctagcatctttaggtagaacaaagcgttcgttcttcatcatctcttcaatcagctccggttcatcgccatattgggctttgtagccatcatagtgatcctgccagacatccgagatatacttcaaaaacagcatagtaagaatgaaatctttgtaagtatcagggctgatggtgccacggaaagtgtcacatacgccccatagcacgcggttgatgcggtcctgatcgatcatattgctcataacaagttaatccttaagtaatttttgcaaaataccaagctcaagctgatggcgatttttctgtaacttattgataagttcatcttctttctgccatacacgttggagctcgataagctgtaattgagtttcaagaggcggaaccgggatagcgacatccagcagagctgatttagttattaactgaatattggtgccactccgatgaaaccattgctgaatcatcggatggtttaacagccagcacaggtattcggggacaatctcacgctcttgtcttctgaggctaacaatcaggaactggctggtagcaaccacaggaacctcgccacgatagacaactgccagattacgatttcctctggccgcaacgacaatctccccctgttcaagaaatgggggagcgatgcgttgttcccatacaacagtaggtagtgctttgtgatcgaactgccagtcctgatcgaggtctttaatctgtaacagacgtacatccccttcagggttaggcgtgattgctcccctcagagtgtgacctgaacggatgcttgcaatttggcctaactgttttaaagatgttggcatacgggcccctgattcattgcaccatccctggcgcatctattcttaagcgtggcgattataagttgtttttaagccattgagagatattgtcggaaagcccataccacgcactgatgaatcccctaatgattttggtaaaaatcattaagttaaggtggatacacatcttgtcatatgatcaaatggtttcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaacccaatctcatgccaaattctattgtataaatctcgctctaaaggccgaaaaaatcagcgctcgacacggactcattgtcaccacccgtcacctaaaatctactcagcgtcggcaaaggagccatggattctagcaactaacttacctgttgaaattcgaacacccaaacaacttgttaatatctattcgaagcgaatgcagattgaagaaaccttccgagacttgaaaagtcctgctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagtaccacgcaccgtctctccgtaaaccagtgacgagtaaaccatcatcgttatccataacggctttgagataatcgcgaacttgagttgccgtttgatcggtgatgataatccaggttgattcgagaggatggcaccaggtcccataggacttgatacgctcaatgagtgaggcataatctttctgcttccgcagatcgtaagaaatttgataagctggcatagatttgatctcctaatttagacgtttgggtttgagtcaacgcgacaggctgcaacctgtcgcaccttcatcactaatctctgtagttatcgtacagagttaaaagtggtgcggtgaagctataatcaaacaaaaaaacaagaatgtaaatctaaaaaaatgcagtagcagctctacagaaggtgattggcgtgttacagctgcaagaaatcaaatgtttcacgtttccataaaccctcaatctattgattttaatcaaaaaaaataccactattgaaaaaatggaacattcacaaattttttgtgcgcagtgacttttatgcactcttgctaaatgatccgtgtagtatcatttcaccattcaacattgattcaagattatccccataccactgcatcatctcccgtcttccctccaggtaatgcgcatggttgtacgtgccgcgaatcgcattcttatccacatgagccagctgtgtctctatccatgccgagttgaacccctgctcatgcaagatcgtgctcatcgtgtggcgaaaaccgtgccctgtcagccttcccttataacccagcagctcaatcacctgattaacgctttcctttgaaatcggctttgcccggtcatttcttccaataaataccaacggatacattccggtaatcggcttcagcgactgaaacagctccacaacctgctccgacaacggaacgatatgtggccgcttcatctttatcacttcagaagggatctcccaaagacgcttctcaaagtcgatatcttcccaacgtgcaaaacgcagttcctgagtgcgaacccccgtttgcatgatgatttgcgtcgccgttttagtgatcacactgcctgtgtacccggccagatccctgatgaaatatggaagttcttctgcggtaaggaagggaaagtgggttttctttggcgttgccaaggcagtcgccagatcgggggccgggttgtattccgcacgcccggtcacaatggcatagcgaaatacctcaccacaacgctggcgtactttacgcatcttctccagcgcaccgcgtttctccaagcgccggagcgtttcgagcagctccattggcttaatctcagcaatcgggcgtcgaccaaggtaagggaatatgtccttctcgaaggtatcaatgatttcatcgcgataacgtaaagaccaacgatcagccttttgcttatgccactcgcgggcgatagcctcaaacgtgttttcagaagagagtttttgcgccagcttatccgccttcttcacctcaccaggatcgccccctgcagccaagactttacgcgcctcgtctctcttttggcgtgcatcagctaaagagacatccggataaacgccgatcgatagcatcttttccttgccgacaaaacggtacttcagtcgccagtattttgagccattcggtttaaccaacagatacatgccgcccccgtcagttagcttgtaagccttatctatcggcttagccgttttcaccttaatgtccgttagtggcatagcatctccattgaaaatataagcagcgcggcgtatgtgtggcacagccaagtcagaggaataaggggttaccgcatagcctgggggtgccaaaaaatagcatgcaattttacaccccctaaagcacccccaaagttttattgatgcaggtagaatccggttgagctccggagacaataatgagcatttaattcagtgattacgggggttttgttgagtttagtagagtgtgggagacactgattggcggaagatcacaggagtcgaacctgccagggaccgctggcggccccatctggatttgaagtccagccgccccaccggggacgatgatcttccatagataagcgttatctaagccagtgattatagcgcgtttattgtatggcgctatccattagattagcaggctaaataaatcccctaataaagtaatgtcaggggatattatcgtccgctcagaaagggtcaataactcacttcgccgtatttgtcacggtgctccttcggtgtgatggaataaccttttttgaacactgaataaaagtattgtagcgatggataaccgcacatctgtgatatctcattaatagggagtgatgtcgccgccagtaaattacgcgccctatcgagtttttcttcatgaatcacgccatgaatggtttggccaacctcatctttaaaacgcttttccagatttgagcgcgacatccctaccgcatccaatacctgttcaactttgatccccttgcaagcgtggtggcgaatataatgcatcgcctgaataaccgccgggtcacgtaacgagcggaagtccgtagagcggcgggccatgactttcactggtgggaccaaaatacgctgtaagggcgggtctgtttgctgtttttgccgtagcttgagacgttgatggagtagcttggccgcccgataccccatttgtcgggttccctgaaccaccgaagagagcgccacccgcgataaataacgggttaactcttcattatcaataccgatcacactcagtttctctggtacggcaatatccagatgctcacacacttgcaataaatgacgtgcccgtgcatcggtcaccgcgataatccccgtctgatgcggtaaggtttgtacccaatcggccagccggttttgtgcgtattgccaattatccggagccgttgccatcccttgataaaccacgccttgatattgttcggcagacactaattggcgaaacgcatattcccgctcctgtgcccagcgcataccgcaactggcgggcaacccatagaaagcaaaacggtttaatcccttctctttcaaatgcataaatgccgcgttgaccaatgccttattgtcagtcgcgatataatctaccgatggataatcttccgactgatgataagagccgccgacgccgacaatcggtacgttcacatttgccagtagctgctctatctgccgatcatcaaaatccgcaatcacaccatcgcccagccaatccttaatattgtcgattcggcagcgaaaatcctcttcaataaaaatatcccaattacattgcgaggcttgtaaatactcgcccacgccttctaccacctgccggtcatacactttgttagcgttaaacaacaaggtgatccggtagcgtttttcaaacatgggggtagctcctgaaatgcatgggatatcaaggctgaacaggcagaaaaatcagcgcggtatggcactgattttcctatgggataaagtcacacccgccgtttggtggcggaatccatccacacggccagcagcaaaattgcgcctttgacaatgtactgccagaacgtcggcacatctagcatgctcatcccattatcgagagaagccataataaatgcgcccattacggcccccgccacactgccaacgcctccggccaggctggtaccgccaatgacacacgccgcaatcgcatccaattcagcgatattgcccgcagaaggcgaacctgcgcctaaacgtgaactgaggatcaaaccagccatcgccaccatcagtccgttaatcgcgaatactgccagtttagtgcgctctacattaattccagacaggcgcgccgcatcaatattgccgccaatagcgtagatccggcgaccaaaagcggtgcgagtagccataaatacccccgccagcattaatgcagtaaggattagtaccggcgtaggtacaccacgataatcattcaataaatatatggcacccagaacgataactgcggtaatagtttggcgagtcacatccccttgcggggcggcaaccggtaaccccaagcggatgcggtgattacgccgacgccattgccaggccacaaacaacatcaggccaatagcaccgatgccaaaaccaatgccacttggcagatagctctggccaatctgcgacatcgcattactggtcggcgaaaccgtcgtgccattggtgataccaattaaaatgccacgaaaagccaacatgcccgcgagcgtaacaataaacgaaggcactttgcgatacgcgacccaccaaccgttccatgcccctaataccagccccagcgccagcgtaacgacaatggtcagcggcaacggccagccgagccagacatcaaaaatggccgctatgccacccaataaccccatcattgagccaacagacaagtcaatttcggcggagataatgacaaacaccataccgaccgccaagatgccggtgatcgccgtctggcgcagcaagttagagatatttctggcgctgagataggccccttctgtcgtgaaggtgaagaacaacataataatggcgatcgcggccagcatgacaaaaacttgtaaatttaaggatttaagccgaaaaaatggctttttatccccattttctggtgagttaaattcagattgattagcttgtgacatgggtttcactcctgagtgcggcttccatgaccttttcttgagtcaggttatggttgataagatcggctttgatgcgcccctgatgcatgaccagcacccgatcacttaatcccaagacctctggcagttcagaggaaatcacaatgaccgcgatcccctgttggaccagttgattgataagtttgtagatttcgtattttgcaccgatgtcgataccacgtgtcggttcatcgaggatcaatatttgtgggtttaatagcaggcacttagccaaaatagctttttgctgattgcccccactcaggcgggcaatggccagctctgaagaagacgttttcactttcaaccgggccaaagactgtacaattatcgattgttctttcgcatcatccagcaaactgaaagcgccagtaaaatcatccagtgccgccaatgtgatattagcgccaactcccatcacgggtacgatgccgtcttttttgcgatcttccggcaccatcgcgatacccaatttcatcgcttgctggcacgtccgaatagtcgcggcttgccctttaataaagatatcgccctgccagcggcccggatataccccaaacaggcactgaaccgtttccgtccgccctgaaccgaccaaaccggcgatcccgagaatttcaccgcgtttcaatgagaaagaaacatcatcgacccggcgaatatgccgattcaccggatgccaggcacagaggttttcaacccgtagaatctcctcgccaatgtgatgggcttcgtggggatagagttcttttagctcacgccctaccatcatggcgataatgtcatcctcgctcatggtcgatgccgggcgggtgccgatatgacgaccatcgcggatcacacagatatgatctgatatctcttttacttcattcaatttgtgagaaatatagatgcaggcaataccgtggttacgcaggtcacgaataatatccagtaaaatggcagtttcactttctgtcagtgatgccgttggttcatccagtaccagcagccgcacttgtttatttaatgcttttgcaatttcgaccaattgttgctgcccaaggcccaattcactgaccggtgtatgggggtcaaccaccagtttgacctgcgccagcatccgttggcagcgtaaatacatggcgtcgtaatccatgataccgaaacggccccattcggagccgaggaacatgttctccagcactgacatttgtttcaccagtgccaattcttgatgaataatcgcaatgcctttttgttctgtttcgcggatattttttgcctgtaaggtttcgccggaaaatattatttccccctgataggaacctacgggataaataccacatagcactttcattagcgtggattttccagacccattttcaccgcacaacgataatacctgccccgcttccagcgttaggctgatattatctacggctttgacgacgccgaactgcttggtaatatctttcatttctagtaggtagggcatgttcccctccttgttatacccttatttattgatgttattgcggtgtttgcggctctcgccactcgtttactgcccatctgcaacaccaataaacgcgggtatagataaaataacggccaggtgattgagagtctattaattcaaaattaatgccttacaaacactggccatttattaaaataataaaaccaatcagcgatatgttaattagtaaatatctgcttttttgtggaacccgtcagcgatgatggtgctatcaatattatttttatcgacctgaataggtgttaacaaataagcaggaacatctttcataccgttatttaacgtgctgtttgctttcggttgctcaccattacccaatgtcacggcgatctcagccgcatcattggccaatttactgatgggcttgtataccgtcatggtttgcgtaccggcaacaatacgcttgatagcggccaaatctgcgtcttgaccagaaatagccactttaccggctagcccttgtgcggctaaagcctgaatggcaccaccggcggttgcatcattagaggccaccacagcatcaatattgttattgtttgccgttaaggcattttccatgatttttaacgcattttctggtagccaggcatcaacccattggtcacctacaatcttgattttaccgtcctttatcaatggattaagaacagtcatctgcccctgacggaataatttagcattattatccactggtgaaccgcccatcaggaaataattgccctgaggtacccgttcaaccaaacttttagcttgtaattcacctactttttcattgtcaaaggagatatagaaatcaatgtcagcgttatttatcatgcgatcataagccaacacttttatgccttcccgttttgcttcagcgatcacattacttaatacttgcccgttgtagggaataataaccaggacatcgacaccacggttaatcatattttcaatctgcgccatttgtgtttcttcattgccattggccgattgaacaaaaactttagcaccgagggattcagccttgttaacaaaaatatcgcggtctttttgccagcgctcaagacgtaagtcatcaatcgccataccgattttaatttctttgctaaatccaggctgactaaacattaccagtgcagcgcatgcggagagtaaaatgttcttaaatttcatcttttggtacctttcttattgtgcaagcagggtaagagaaacggtaaacatcaactgcaataggattgttgacgcttattagcacatcggcaattacagattttcatccgccaattatgttttttggtttaatgttaattttatgataacgatcatgttttctttcctcataactgcaggtttatgccgaatttttcatctatctgatgaatataaagggatatttataattaagtcgttatttatgagatctacaccacaattaataattctctgaatttaagtgtgaaataacgtaattgagagaatagccaataactccgaagatatagcctaaacaattcgagtggcaggccggcggtcactgaacgaaggccgctaacgtataagcaacttgaagtctcacgggtataaacgttcaccagcccagcaaaagcagggcctgcttccaaggagtattgcatgcaatcttattttaatgaattagaacaagtgcgctacgaaggtagccagagcacgaatcctctggcgtttcatcactacaacccggatgaaatgatccttggtaagcgaatggctgaccatctgcggtttgccgcctgttactggcataccttctgctggggtggggccgatatgttcggtgccaatgcttttgatcgcccatggcaacaacctggggatgcactggctctggctaaacgcaaagccgaggttgcatttgaattcttccataaactgaatgtaccgtattactgcttccatgatgtggatgtctcgccagaaggcgcgtcactacaggaatatctgaataacttcgccgtaatgaccgatgtactggctgaaaaacaagcagccagtggtgtgaaattattatggggcacggctaactgctttacccatcctcgttatggtgctggtgccgcgaccaatcctgatccagaagtatttagctgggcagccacccaggtctttacggccatgaatgccacccgccaactcggcggtgaaaactatgtgttatggggcggacgtgaaggctacgaaacactgttgaataccgatttgcgacaagagcgtgaacaaattggccgctttatgcaaatggtcgtcgaacataaacacaaaacgggtttccaggggacactccttattgagccaaaaccgcaggagcccactaaacatcaatacgattatgacgtcgcgacagtttacggcttccttaagcagttcggcttagaaaaagagattaaagtcaatattgaagccaaccatgccacgctggcggggcactctttccatcacgaaattgccagtgccatcgccttaggtatttttggctcagtggatgctaaccggggcgatccgcaactgggctgggataccgatcaattcccaaacagtgtagaagaaaatacactggtgatgttcgagatcctcaaagcaggcggttttaccaccgggggcctgaattttgatgccaaagtgcgccgccaaagtaccgataaatatgatctgttctacggtcatattggcgcaatggacaccatggcactggcgctaaaatttgccgccaaaatgattgaagatgggcaattagatcagatcgttgccaaacgttatgccggttggaatagcgagctgggccaacagatcctgcaaggtaaaatgtcgctggaagagctctcccgctatgccagtcaacataatctgaacccgcagcaccaaagcggtcatcaagagttgttggagaataaggttaaccgctatttatttggttgatcgtttactgagttgatcgtttactgggttgaccgcttactgagcttatacaccctaccgggtcgtccttagaggcggccaaaatggcgagtagaatagccgattaaaatttgaggaaagcatatgtatgttggtatcgacctgggcacctccggcgttaaagctattttactggccgaaaacgggcgagtaattgccagccaaaacgcagcactggtggtttctcgcccacatcctttatggtctgaacaaaaccccgctgattggtggcaagcaaccgatcaggtcatgcaagcactggccgcagaacacgatatgcagcaagtgaaagcgctcgggctgaccgggcaaatgcacggggcaaccttgctagataaacaacatcaggtgctgcgccccgccattttatggaatgacggccgcagtttttcccagtgccaaacattggagcaagcggtaccggcatcacgccagataaccggtaacttgatgatgccgggctttaccgcccccaaattgcagtggctggcagaacatgaaccagacatgtttcaatgtatcgataaagtattattaccaaaagattatctgcgcttcctgatgagcggtgattttgccactgatatgtctgatgctgccggtacgatgtggttgaatatcgcacaacgtgactggagtgatgagatgttggctgcttgtggtttaggccgtcagcacatgccaaccttgtttgaaggtaaccaaataaccggccatgtcagtgcggatattgccaaacgttggggtatcaacaggataccgattgtcgccggcggtggcgataatgcagccggggcggtgggggttgggctgtatcagcccggacaggcgatgttgtcactggggacatccggcgtctattttgcagtcagcgagggttttctcagtaatccagccagtgcggttcacagtttttgccacgcactgcctaatacttggcatttgatgtcagtcatgctcagtgccgcctcgtgtttggattgggcctgccaactcactggggccgagagcgttcccgcgttgattgctgaggtagaaaaaaccccaatggctgcaacgccagtgtggttcctaccctatctttccggcgaacgcacccctcataacaaccctaaggctaaaggggcgttttggggcttcacccatgaacataggcggccagatttagcccgcgcagtattggaaggtgtcgggttcgcacttgcagatggaatggatgctctccatgccagtgggctacaaccgaaatcagtcacattaattggcggcggcgctcgcagtgcctactggcgacaaatgctggctgatatcagtggccaaacgctggaatatcgcaccggcggtgatgttggccccgcgctgggcgctgcccggttggctcaaatcgccatgaacccagatgtatcactggctgatttattgcctgcactggcgttggaacaaacgcatttaccggatccacaaaagcatcactattacaccgatcgccgggtaacctttaaaaaactttatcaacaattgctgccattgtgtgagtagttgtcaagagtgcgaataaacaccgtgctgggtaattcattattactcagcacatttttatagggccacggctcacacactaataataattaatcttaatgattgccgtagcgtcaaactggcccagctttatcggttgtccttcaatggcatttaggcgggcagtataatttcttgtcacctgagtaatattattcaattgtgcaaaatcagcataacggttgtatacaattgcctgatttttatcatcataaatggtcagtttaatgccgttttgcagatcaatcgcattgtcacccactaatgggttagcggttaaaaactgtgcctgaatggaaaaattagccaagcaaccttgttttatcgcagtaatagaaaaaggctgactgagattattattactagacagtaaccgggcttgattaaatgaaccaaaattcacaacttgtgacgccggagaaatcactaaatccgcaccacagggaataaaacgtacaatgcttaaaccagacaaggtatatttcaaatttttggcacccgcagtaacgttaataccaccagagccatccaattggaataccgtaaagctatccgtgccgatataatttccactggagggaagatcattagtcactttaatatacagacggaaagtcactgttaccgtcacgttttgcccgctagtgattgggctggtattggtgtttaaacgagcagcgttggcttgtagatcttgccctaagtagttgacacctaactgtaaccctggccctaatgattgcccaagcggattaaaatagaaccagacctgatcatataccgagcctaaaacattgtcgcagtatgccgttaccgtaatatctctcgattcccagatttttgtgccaggggcaatgttagacggtattgctaattggcctatcggaatgccgggtttattcacaacattagtacctttctctacacaatcaagcgcataggcagcttgcgataacagcattgccacgaataacagggcaatacagccaccgattcgacctattttatttaaaatagtctgcatcattgttattccttattcatatgctgaaccgggtacgtgtatcaccttctcttttcagctggctgaatttggcattctgctgataaacagttaaaagtgcgtatcacaatgcccccaaaatcatccatataaccaacgttataacggctaccgctataacccggcgttttaacaaactcagtaccaaaaggcgcaatcatgacgctgtcaaaaccaggaaagttaccttgttcattctggctcaaataagccaacgtaatgtaataaggtgtagggttattaattttaagcccccccacttgtttactgatctgtaatttctcttgccagatatcgctataattcgctttgatagccatgggccgataaaacagctttatccgattttgaatcgcaatttgtacgacattattcatttcgctttgcggtgggatttcccgcacattgaaatagaataatgtctcgcgatcagtgggtaatttatcggcatccggtagtttcatgatccgaacctggcttttttgcccggcatcaatccgctgcatagggggtaaagccaccaatggactctctattttttggcctttggtattttccaaccaagattgcgccaaataaggtgatgacgggctctggttttgtaaaataacactggctgatttatcagtactattaaagataatgcgtgtccgatccaggttaattgccgcctgactggttagcgcagtgagccacaaggctatcccgaatagcgctgtctttgcccacaaacgttgttgtctccatatcatgctatttatgtctttcatttcgctattccactgtaaaaggccgcatttggctgtgaataactcagtttcgatcaacaaccgttttaatgaatatttttccccaaaaacacttactggcagggcagtagtacctttcctgagttcattcctttatcttttggcaatatgagcgtgcactgttttttcccccattgaacagtcagcctctcagtgtcttgtaatcccgccaaatacgtcaggccatcgtctcccacaattccaacttcagcgcccgttttgtccgtgataacggatgcccccaaggggggggaactgccatctttcaggcgaataatcgccatcatttgccgaccttttaccgcccttatctcacggtaaccaattgccccttcggtcagcgttttttggataacggtgttgtagacctcaatatcatccggcagattctgcacatccacccgaatatcagactgttggtagctggttgcgccactgaccaccgccacaccaaaacggttcgtcactgccgagttattattcagcgacacccctgcgacatccccggtatcaaccattattcttggttcattgcccgctttattctggtgggcagcaaccccataagcggttgccgtaattgagccataccagttggtattgattgagttgtactcattatttttatggctaccatcaagaccaaattcaccataaggcgagctatgttgataaccaccacggaacacaccattacctttttgcagttctgggttaccgccacccgcgctgatacgccaaatatttttcggattctggttgttgaaataggagatattttgcgtgtagccggtattgcggcctcgctgtgcatcatagctggcctgctggcctatgccgatcggtacgctgagtgagaagaacatttgattctcattggcatactgattattcaccttattagcggatatcgtcgccgaaatacccttaaaagtaccgatatcaaaaatcttgctcatggatagactgtagttgttactggaggccgcattccaataggttctacgtgtcaccgataaatacatcgtgatatccggccaggccagatactggttagctgccacggtataagcctgcttgtcatattgcagagcagtattgccgtttagccaatccaaatactggctcatactcataaaattcttcttcgagaaacggtatccggcaaagctaatctggctgtcagtctgctcaaaacgtttggaataattaacgcgatagctttccccgttctgctgttcttcatttggtaactgcgcacgggaatgggtgatatcaatagacagtgcgccgaagtcatataaattttgcccgatgcccaacgcagccgaggtgtaatcctgcgaagtcgtcatcagcccaccgtataatgaaacatggttaaatgcgccccacgagaattcgccactaaagaatgtcggattactggctgaattatttccccccagcatcgggcgacccaacgcagttttatagcgcacggcacctttacgggttaaaaatggcacgctcgcggcgttgacttgaaacacggtgacccggccatcttcctcttccacgcggacatcaatattcccttgtacggcttcgctaatgtcttgaataacaaaggggcctggtgcaacgttagtctgataaagcacccgcccattctggctcaataccacgcgggcgttggtgtgagcaatgcccattacctgtggtgcatagccgcgtaacgtcggtggcaacatgcgctcatcactggaaagtgaagtgcccagaaaacggaatgaatcaaaaatactggagttgagataagtctggccaccgacaaatttagcccctatcgaggggatggctcgaaaagcatacacttgcgaccaatcaaaattacggtagtgctcgcccgccgtttctgtattgatatattggtaatctgcacgaatacgccatggtcccatattagccccggtagtgccgtagctgctgaaatttgtggtactgccgcccatattcggtgaataatgataaccaaacaaattgtaatccaataaagtaccagcaacaccgtttccccattgtgaaggcggcacccaattgggatcgttataagccagccaagcttggggaatagaaataattaaggattgcttctctttatcgtactgaatttttatctcttttttttcatcaatagcaacacacttgtcgttattccataatgtcatcgactcacgtacttccgtagataaaccaaatagattaactaagtcaggcgtcaaacagagcttcgttgatttcccttcatcaacagcgagataagtcactaaataacgttcaggtaacagcctatcatcaataagaatatcaagtagataattccccggaggggtgtaatcatcaacctcaaaacgagagagatcgatattactacggtctttagcatcgataatattggtattgaattttactactgcagtcgattcaggcaaaaataaccatactaaaattattgttaatactttcaccattaggaagatggttttttttcttttagaattatatggcatatataaaccattgtcttatggcgataatattaattagaggggagttacctcccctttaattactttaaacatttgttatttataattcagagcataggttgcctgagagacaacagtaccggtagttactggcgcactggtggcttcaatacgagcagaaaatacaatctgattcggaccagatgtcagattaatatcaggactcgtatcacccactttgagtagcgcgtcatcagtgccaataaggcgaacacccacgcctttcgcgctaccggtgttagccagcagggctggagccgccgcatcagcaataccgctgaaggtgacattgactttagacagtgcaggataagtggcccccccactcccttgagccgtcaggctacaatcttgcagattaatgttataccgtacgctctgagagtatttgttacccgtctccagaaccctattcgcgacctgccctaggtctacattaatatcagtagaatctaatgcaattgagcacggtgcattaataaccgttccagtgaacttaatacgcccattccctgcatcagcagctaaagcctgataaataacagataaagttgctaaagcaataataaaagtgcttttcttaacgttagacatattaaaaacctttatgtagatattgcatttaaaggatatatctctgaaataccaatcacataatagaattattaataatgagtacaaccatggttaaattaaaaattgttaaaggagtctaatgtaataaaaaagggaaattaaatcattatatgaccgtgagatcttactctctaaaataaaataacccaaataaaatttaacatcaatatcaaatcatcaatacactcttgagataaaaatttcattaaaaacacgaaaattttattggattatttattataaccaactgaaatagaaaagtatttatatgctaaattaccttgatgggcagaattcaggcgtgtcgatttcactcaatgtcacgctttcatcttataaaatagacttaaccatcaattgtattactatttataaaaaaatagattttcaatataaataatcagacttaacagcaagctacgaatgacaaccagaaaaaacaatcaaataaaatctttaaatatatttataataaaattatatatttttaatttaaattaaattaaaaatcagaattatcagtaaaataaaatgaaaacgcccacaatacaggttaattaattctttaaagtgataggaaaaatcttatttatcatgtcaatatgtatattttaatgaataaatttaacacaatccaagccactgagaataaaccctctcggtagcttttttataaaccaagataaaaaataactttagcattaaagtcagtgtcgtatattggctctttccactattagctctttccatagggctgaatctgttaatcatgcactggagtcattaatcatgaatggtctcattaatcataaagtgcccacagtggggggtcaccgtggttaactgacccaccgtcgccgatcaatacgctgcaatcccatcgataataatgtacttaggcccagggtcagtgcaaaaacatacagaatatccagcactgggtaagccgtgaaatcataatgatgcgtgcggataaagtggataatcagcgcatgaaaaccataaattgccagtgaatgcctggcgagcccacttagccaggcaatgtgctgattcagacaatttttaaaccaaacccacagcgacaccgccgcaatgaacaccagcgggctacaatacatgtaaaacgtatcagcaaaactgccattaattcgtgtctgtttttccgttgagatggcaatgcatattacactcacgacaaacagcaataccgctccccaactgatcatccgcccttgagtttccagcatacccatcgctcgacccaacagggcatacagcaaataatagaaagtatcgccgtaaatatagaggttagcaggcaacaaacggaaatcatcaagggagaacttgctggtttgcgggttggcgacgacagccaataacaggatcaatattgccagatagcggcccgaaacgggtttaaccttaataaggggcgagaccagatagaccacgataatggcgtagaagaaccagagatgataaaacaccggtttttgcaggatatttctcaacgaggcccagccgtcgattggggtcaatgttgaaatatagatcagtgcgatcacgctataaaacagcagacacagtccaatacgcataaagtgttttttctgagcacttttttcgccaaagaatagatagccggagatcataaaaaataaggggacacacgcgcgggaagctgagttcagcacattggcgatatcccagttgagttctcctacctgtgcaccacgggtcacgtaataagtggtggaatgaatcatcaccaccataatacacgccaccgcccgaaggttatcaatccagtcaatcttattggtcatgcctgctctctgttatctgtattgtttgttgcaataatgtttgttgcggtatcgcctgctgcgccgttatcggctgaaatttagctgaccaaattgcctgaatataagtaggtacgctattatttttacaaatgattatttttataaacgctgcttggcgaataataacgtaagtttggggagatacacagagtcataggggtttttggttcgttcggtgatttgagtctgtgatcgggttcggttgttatggctttacggcttacctggcctccgatgaaccaaccgccaatggggccataagtgcactgaaccccagatcttggatctttttatccatgatctggaggttcggttcaatgaaacaccctttttcaacccgcctagcggcggttcaacattacctttcaggaaaggccactctgcgggaaaccgcacgtcaattcagtgttggcaaatcccctcttacgcgttggatccgagcttttcgccgtcaaggtgaggctggactggagcaccatctttccagaacttatactccagaattcaggctttgcgttgtccgctatatgatggcaaacagatgtagcgctgccgatgcttctgctcattttaacattcccaacgagacgattatccaaaactggatgaaacgttatcgagagggaggaaaagaagcgcttaacccatcgaaaacgggtcctactatgccaaaagataaatatgagcacgattcaaaaccgttcagcgagatgacgcatgcggagctagagaaagaacttgagtatctgcgcgcggaaaacgcttatctaaaaaagcggaaagccctgagagaagaaaaggcactcagggagcagcagaaaaaaccagaatagttcaagcactgacagcagaacatcgactttcttgcctactgtgtgccgcaaaattggcacgcagtacatactattatcatgcatcgaaaccggacggtgtaattgatgactatgcagatgcggtaaaagcgattggcgccctaagcagacgacacgcacagcgctacggttatcgccggatgacggtcgcactgagaaaagaagggttcacactgaatcacaaaacggtgcgaaaactgatgaatcagcacgggttactcagcctcattcagcggaaaaaatatcgctcctatagggccgatggtggccgggcatccgataatctattggctcgtaattttacatccgaaatcagtggattgaagtggtgtacagatgtcacagagttccgagttggagcacagaagctgtatttgtcggtgatacaagacctgtttaataatgagattatttcttggcatatgtcagaaagagcagcattaatcctgacgtgcaagacgctggaaaaagcgctgaaagtgaaagggagaaaagaaggcctgatgttgcacagcgatcagggctggcattaccgaacgccgatgtggcgctcaatgcttgtcgaggcggggataaggcaaagtatgtcacgcaaaggcaattgtttagataatgcagtgatggaaaatttcttcagtcacctgaaagccgagatgtatcaccgtaagaagtacgattcagccacagttttaaagcgtgacattgtagaatatatccattattacaatacagagcgcattagcctgaaaacaggcggaatgagtccggcagaataccggactcaggtagaaaagcagtaaagcagatgtccaagttttggggttcagtgcacttatggccccattggcggttggttcatcggaggccaggtaagccgtaaagtcataacaaccgaacccgatcaccgactcaaaccaccatcaaccgaaacccgatcaccgactgagatctccgggattcacaacaccccctttttatctcccaaaatccccttcactatctgcacatcctgaatccccaacccggttaaatccgccaaggtaatctgttggtcattctctctaaaagggatgccttgcgctaaagctaaaccgatctcagttaagttgtgatgagccaacagcccttgcttaaacgctaacgaaacttcgccaaaatcggtgcattgcgcgattgaatccaccagaattttatcggctctcgcgactaactcggcggagagctcgtgcttacccgcgctatctgccccaaccgccgtaatatgtgtccccggctggatatcttcagcctgtaaaataggctcccggcttggcgtggtggtgacaataaattggctgtgatgggccagctctgcggcattcaacgtggtgttgactgcaaagccctctgcttgcgcatattggcgatactcctctaatgccgtttcactgcggccccagacccatagctggcggcaagtcatcacatttttcaggtacatcagatgcagccgcgcctgtattcctgtccccacgataccaagggcgctgatgtgctgtggcgcgcaaagctcggcgacaattcgcccggccagtgctgtgcgcagcgccgttagccagccttcatccagtaagatcgcttgtggctcaccggtttttgccgaaaatgccatcatcaacccttgattactggctaatccttgagcagggttatcataaaacccaccggagaccttcacgacaaactggtcatcgccctgtaaataaccacttttaatacagcaatcaccattggcctgatcaaacagtaaatgctgtactggcggcatctggacccgttgctgactaaaagcaataaagccctctttgagcaataatgtgatgcgatccgcatcgaacttgtcgagaattttttgtttattcagaattagcatccgctgacagctcccagatatttctccagcacgatatttttaccgcacaacaccaccgccactttcttaccttgccattgcggagccaatttcagtgccgcagccagtgccacaccggcggcaccttcaatcatccagcggtcagtacgggcaatcaaacccatggcctctttgatttcttgctcactcaccagcaccttctgatcgattaactgttggcacagtgcaaaggtgatcgctcccggttcgataccaccggcggttccgtcagacagcgtttcttgctctgccacctcctgaatctgtcctttctccagacaggtatacaggctggtggcattggctggccagcaaccaatcacctgcgttttatccgataatgttttcaatacggtcgcaatacctgaaatcaggccaccaccaccaacggcaacaaacaccgcatcaagctcgggctgctgttcgaccatctccatgccacaggtgccttgcccggcaatgacctgcgggtcgttatacggtgagatatacactttaccttgttgctcagcggcgataccggcggccagttcagcatttaaggcatctccggagactaattcaatttgcccccccagtgcacggatcacatccagcttgatggctgccgcctgttctggggcgtaaatagtggatttaatccccgccagttttgcggccagcgccacaccttgcccatggttaccggtggaggcggtgatcacaccttgctggcgttgtgcctcattgagtaaacgtaacttgttactggccccacgaaatttaaaagaaccggtgtgctgcaggtgctcacatttaagatagatctcacaaccgctgtgttgagatagcagtgggctatgctccaacggcgtgactctcacttgtgggcgtaatatctggtgggcctctctgatggcatcaaacaacgtattcatctcgattcctttaaattttattttcaatatatccgtggtacagcaagttgtctgcgcgctagctgcttcctgcaactcgaattatttgggggatatacgtcaaaacatgacggggcgttctgtgtgtcataatggcatacatattcagcaaaaaatgtcatttgcaacttatcataaaagaattaaaagcataaaagagttgaaaatatgaatgcgcaaaaaacccgtttcttaccggaacagcagcttacctttgatcccagaggccatcagctcaccaatatcaatgtctggaccccggatagccagtggttggcttatgatgtgcgccctagcggggggacttttaacggcttaacgattgagcgggtaaattgcattaccggtgaaattgaggtgatttatcgtgctcgacagggtgctcatgtcggggtggtgaccgtgagtcctgatatgcccgcacgctatgtgtttatccacgggccggagcacccagatagccattggcactacgattttcatcatcggcgtggggtgattgtgtctgagccggatagagaactggcggtgaccttagatgccatggatatcacggcaccgtatacccccggtgcgttacggggaggcagtcatgtgcatgtttttagccctgatggcagccgcctcagttttacgtataacgaccatgtgctgcatgagcgggatcctgcgctggattgtcgcaatgttggtgttgccctgccgttacgtggtgtgaatcctccgaaacaccaccctcgtgagcacgatggcagccacttttgtgtcttgatcagttgcactacaccaacgccacaggctggtagcgaccagattaatcgtgcttatgaggaaggttggataggcgcgcggggttacgtaaaggctgatggtactcgccagcgttgggcactggcatttatcggcgataccttttccgtacagggagagaaggttcctgaaatttttattgctgatttgcctgagcatgaccgagattatgcacgtgccggtacacatccacttgagggaacggaaaacacgctacccgcccccccagtgggcgtgagccagcggcggctaacctacaccactgaacgacctttccctgggctggcaactcgcccgcgccactggctgcgttcatcgccggatggcagtgccattgcttgcctgatgaacgatgataacggtgtggtgcagttatggttgatctcccctaatggcggcgaactgcgtcaactgacagcgagtcaatgggggattcagtctgcatttagctggagcccacagggagagcatttggcctttatctgcgataacagcgtgatgttgtgcgatagcctaaccggacatttacggcggctgacagcccgcagcgtggtggccccgctggctgacgctgtggtgttttcaccaaacggtaaaaagatcgcgtttatgcgtgagatcgatggatgggcacaaatttttactgtgcatgctgattagcatcgacaagatctattggctggagaggggggagcggatctattattttggcgtatcacctgtctgattagtttgctggttttgcatctcggattgccggacacgttcacgcggtgaactggtcattttgtcttcattgtctgaacgcaaataatcgtagggcaggaatagggtatccatcacggcggagaaaggcaggtctactgccagtaaggggcgtagtgcccagccggtatcgtcatctttgagcatggcgatattggcttcggtgccagagtaatagccttggctactgctggtgtgagtcaaaatactggaacaaccgctggtcagcagcagcgaacagccagtagcaaaagggataacgatatttctcattatgttattcggctctcatcaccaagtgattaacccacgacgtcagtgtcaggttttgtctttcatttttacactctcttacagacacttcctatagtcaaaaattcaatcttatggacttatttttgtttaagtgtaagtgatagcggccatttcatcgaatatttaccgcctgtattttccaatacgattttttgcgaaaaattttttgatctcatgcttgaaaaaaagaagaccgcacccattttattatcaggtcagagagaatacgccgatagggtattcagaccacgggcctgtccagagtggaaggcttaattataacgtttgataacacccttgctaatctatttaggaggcagtttgtatgcgtaattccgatcttgctccattgtatcgttccgctatcggtttcgaccggttgtttaatttattagaatctggtcagaaccaaagtaatggcggttatcctccttataacgtcgaattagttgacgaaaataactaccgcattgccattgcggtggcaggcttcgcagagcaggagctggagattactactcaggacaatttgttgattgttcgaggttctcatgccaatgagcctgcgcaacgcacatatttatatcaaggtatcgctgagcgaaactttgaacggaaattccagttggctgaacacattaaaattaaaggtgccaatttagtgaatggcttgttgtatatcgatcttgagcggttggtacccgaaagtttgaaaccacgccgtattgaaattaagtaatcagcccttatatggatttttgatcgtgtgaatgagttacatatacccaagtgacttcgagaggtcggtaggcggtaaccgagtaaaccgcctgaagtttagataactaagtgatggggtgagcaagagccgctaacatccctgtatcttgaaggacgacgggtatatttaataacagtgtttagcctgccgtaatcgggggctgaccggtcacggactgtttatacaacgttaatccgtggctacctattatctcgcttcaaagaaggagttaacgtatatgcgtaattatgatttgtcacctttacttcgtcagtggattggctttgataaattggccagtacaatgcagggcggtcaggagccacaaggcttccctccttataacattgaaaaaactgacgataaccactatcgcatctcactggcgctagccgggtttaaacagagcgaattagatattgaagtcgaaggcccacgcctgacagtacgtggtaagccaacaccagtggagaaacaggtcgaatacctgcatcaagggctggttcgtaaagagttctcgttgacctttaccttggctgagcatctgaacgttgataatgcccagtttgaaaatggcctgctgcatattgatttactgcgtcaggtgccagaagcactgcaaccacagcgtattgccatcggcagtgccacacctcaggagcgccaggtattagaaagcccggaggcacctgatcagcagtaatgggtgttaagtgaccttgtggttttgataagttggtttaaacgttagtttttaacgtgtcgttatgatgaccggtgccctctgcccggggtaccggcagttacctcttattgcatgactctcagttgtgtgtttttagcattatgcttttcccttgtttgtcttttcaccggagagattccccgctctccggtgcattttgtggcgtatcccacattcaaccttccccccttctgacagaatccctactaattgtaagaatttaaggccatgccgtgcatctgaggcaatcatgatgctggtgagaatagagaatccctgtgggaatggaagcggccaacctatttttaaacttaggcaaggaagtgatttatgagtgctatcgcccttaccgtcagtatgttggcgctggtcgccgtattggggttatggatcggtaattggaaaatctatggtgtggggttaggtatcggtggggtgctatttggcggcattattgtgggccattttgcacaaacttatcagatcgttcttaacggagatatgctgcattttattcaagagttcggcctgattctgtttgtgtataccatcggtattcaagttgggccggggttcttctcttcactacgggtatcggggttgcggcttaactgcttcgccatcttgatggtggttgtgggcgggttagtaaccgcgattattcataagctgtttgctgtgccgctgccgattattctgggggtgttttcaggtgcggtaaccaatacaccggcacttggtgcggctcagcaaattctcaccgatttaggttcgccgccacaactggtcagtcaaatggggatgggttacgccatggcgtatccatttggtatttgtggcattttactggtgatgtggctgattcgtttattctttaaaatcaatatcgatcgtgaagcgaaagcgtttgatagcagctatgggcaaaaccgcgagttgctgcaaaccatgaacgttgcggtgcgtaaccccaatctacatggtttatcggtacaggatgtgccattgctgaacagcgatgaggtggtctgttcacgattgaagcgtggcgatttactgatggtgcccatgcccgccacggtgattgaaattggggattatctgcatttggtcgggcaacgggatgcgctggagaaagtgcggctggttgtgggtgaagaggtcgatgtgacattatccacggcaggaacggcgttgcaaacggctcgagtggtagtgaccaacgaggcggtattgggtaaaaaaatccgcgatcttaatctaaaacagaagtatgacgtggtgattactcgtcttaatcgcgcgggtatcgagctggtcgccagcaacagtgccaacttgcaattcggcgatatcctgaatttagtgggccgtcctgaagctatcgaagcggtgtccgcgattgtggggaacgcgcagcaaaaattgcaacaggtgcagatgttaccggtatttatcggtgtcggtctcggggttttactggggtcgataccgctgtttgttccagggtttccggcggcattacgtttagggctagcgggtggtccgctagtggtggcgttgatcctcggacggattggtagcattggtaagctgtattggtttatgccaccgagtgctaacctggccttgcgtgaattggggatagtgctgtttttgtcagtggtcgggttgaaatccggcggtgattttatcaatacgctggtcaatggtgatgggctggcatggattggttatggtgcgatgatcaccgggataccgttgctaacggtaggtattttggcacgtatgctggtcaaaatgaactacctgacgctatgtggcatgttagcgggttcgatgacggatccacctgcgctggcctttgccaatggcctgcacccgaccagcggtgcggcggcgttgtcttatgcgacagtgtacccgctggcgatgtttctacgaatcatgtcaccacagatattggcggtattgttctggacgttgtagagcgttaattcgcgggctattaaacttcagggcagcgtaattggctgccctgtttgtattggtgaagggggtaacggcgattcactctgttggcgagttaacagtatatttattaatcagtaagttgtttcgcttcctgaaacgctcgttcaatctcttccgccaagatcgcgacacctttttcaatcatttccggagccggcacataattcattcgcatacattggtgagtatgtggccagtcatagcccagaccggggaagaagtaatggcccggtaccatcagaacaccacgttttttcaggcgctgatagagcagttcggtgctgattggcaaatctttaaaccacagccagaggaaaatagcgccttcgggtttgtggatcaggcagcgttcagcgggcaggtatttgcgcaagatggcgatggtctgctgtacacgttcaaagtaaaacggccggatcacctcgttggataagcgcaataaatcaccacgctcaatcatttcggcggcgatcgcgggccccatcccgcccggtgacaggctgataataccgttcatattggtgatggccgaaatcactttttcatcggcaatgacaatcccgcatcgtgaacctggtaggcccagttttgacaggctcatgcacaagatgatgttcgggttccacagcggtgtggcgtcggtaaaaataataccagggaaggggacgccataagcattatcaatcaataacggaatattacgttgctgcgcgatagcatcaaggcggattaactcttcgtcagtaatgacattaccggtggggtttgtgggccttgatacgcatatcaagccaatatcatcagtaatattgaggtgttcaaaatccacgtgatatttaaactgcccctcgggtaacagctcaatattcggtttggcggagacaaataaatcttcatccagacctgcatccgcatagcccagatactctggcgccagtgggaacagcacccgacggcggctaccatcggcataacggccagcgaacaaattaaataagtagaaaaatgcactctgactgccatttgtcagtgcaatattctgtggctctatctgccaacccagctcatcgcgcagcatttttgccagtgcttttagcagtaagtctttaccttgcggcccgtcgtaattacacaatgcctcggttaacttgccttctgttagcatctcctgacacagttgttggaagtaggtatccatctcagggatatgtgccggatttccgccaccaagcatgatagaacccggtgttctcaggccatcgttgaggtcatccatcaatctggtaatacccgcataacgggtaaatttgtcgccgaaaagtgaaaacttcataaatgaaaatgtattgttatctgtaagtgaacaagtaccatactcgcagataaaagcggacgcaatgcggaagaatttcttctgactgcgtgaaaatatcgccattcatattcagagcgggataataaactaatctggctaaaaaagtaaaaaaccatgaaatggcaagaggagagaattaacctttttttctaaggagtaaggggattattatcatgaaataaggcataaaaagccaaaggagagcaatggatttacttcttccaagatagtttagacacctaatgctactagaaatcaaaggtactataaatagcagtgttaacaagatagaaaatgattcttttgagagaacaaaaaaatataatgagtaccaacataactgaaatattaggaataatgcatattcaagtttgctttctttcccgtacgagtcaaaagaaagtttgtatgccctaattatcagctttagaaaatatatttatcactttccttataaggaagagatttataattgagctaagtatgatgttacaggcaataattaagtcatatccatgaattacattatggttagcataaggagatgttctgaccataaagtgactaagggttaacgttaataaaagaataaagtaaaaagataacgataagaaggaaaagaccattttattttgaatggcaccctctttaatgaaaagtaagggtaaataggaaattgtgacgctgattgaaagaagtaatgcattaactgcatttgatgtcatcaaagtaaaaacatcataagccagtatggctttactaccatataaaaaatatatcatgtggtaatataaattaaaaccaataagtagtgcaataataaaagaccctattaggaatgcgattctatttttcattagaagataaacgccttttacatttaaattggataatagtctttagttgttgtcatattatcattatttataaaaataaataaattaagttttcaagtatatagttgattaagtaaatgatcattaaaaatgatataaataagacatttcttgtttaaagataagcgtgtagataaatgtggtaaaggttccgtattttgtatttatcctaatgctacagatcaattgacggcagaaacagacgttgagtttgtatttttatgcccggaattgcatgtgactggtgaccgaacgttatttagcgatcgggtatccccttcgtccttgacgtcgcagggggtagctgcggaatttggctgcctcattatgctaaccgcacgcgcccgcacggttagctccagatatcagttcttatcaccgacccaaacgaccagaaccttatcgccctgatgttggcggctaaaggcatagtaattggcggtttgttgcgattgttgtacaccagcgcctatcgcgggatgacgggcgcggaattgactgactttttgccaatgggccaacagtgcgcctttttcgcccgatagctcactccagttcatatccgaacgggtaccctgcaacggatcggaaccggttgggccaaacttccgcccgctttcatcaccgtagaagatttgtactgcccccggagccaacaacagtaaagagcctgctcgctgctgttttgccagtgactgttgtgcatcgtctttaaagaataaccgggtatcgtgagacgagaggtagctcaacacattgaagttttgcagtttctccgccatttggttgtaggtactctcgatagatgagaagcaggccagcgcctgatttgcctgatcctgaaaatcaaaattaatcatggcatcaaagccattttggtagtaatcacttttcatgacaccgtggccccaagcctctccggtcatccaaaatggcagattatccagcgcctgttctggatgtgcggctttccattcggccagtgccgcgatgctctgctgctttaattgttgccaggcgggtttctctacatgcttggcagtatcaacccgaaaaccgtcaatgccgtaatcgcgtacccattggcttaaccaatgcgtcatataatcacggggtgtcgcaccggcgatttcttgggctgcggtgtccggtttgttacggtaaaacactggcaaaccgctgggctgcgtcgattctgttttgatatcgggtaggaaggccagcgacatcgtcagatcgtcataaccgggggtgtcgtaatcaccaatatcggtgcggatccactttttaccccaccaattatcccaagcggtcttatcactgaagttgatgtaatcattaaagctgtgccaggtctgcccgctgccaggggtccagtcgttccaacgcttacccaaggttttttcctgctgatcgccttgcaggtagagcgccccgaattggtcgttctgcatatccgccagcgttgcataacccacatgattcatcaccacatcaaataggatgcgaatgccgcgtttatgtgcctgttcaaccagtgtgcgtaaatcctgttcggtgcccatattggcatccagacgggtccagtccagcccgtagtagccatgataggcataatgtgggaagtcgcctttggtccccccgccgacccagccgtgaatttgttccagtggagaactgatccacagtgcgttgaccccaagctgttgcagataatccagcttctcggtaagccccgccaaatcgccaccgtgaaacgttcctatctcctgcatcccatcgccatgacggccatagctatggtcgttcgctgggttgccgttattaaatctgtcggtcagggcaaaatagaccgtagcgttttgccagctaaaaggcgcggcttgctgtgtttgggccgattccaacagcagtaaaccaccactctctggggcgggtcgtagcgtaatttttccgagggaaacggttgctgtttggccggaatagaaatcccgtacaatttcaccttcggcaaaggttttactgacatccacggtcacaggattgccatcccagcgttggcaactgtgggtgacgacctggattgcctccgctacgggtgcggtgacacttaaggtcagcgtcggggtgccgctacgggtatcgattcgcgcttgatactggccatcacggaacaaccgccacggtatcgcgatattctcctggcaaggctgcaacgagagcatttggttcagctttaccggcccggttggctgccagcactgtttatcctgataaaattttagagggtattcgcctttggtcagtgagctgctactgagaaaaataccgctgtcctgttcagtaaaagccgggaaatgctgtagggaccagttcgccatcgctgctggtgaaagaaccagtagcaaggggagtgtgagacgtttcatggcgcgtcttcctaatattgggttcgagaaacgtataaagtttgaggcagattcagtgtgccgcttggcgaagaaatagcctcatccctgagcggtttttgtagggaggaggggggcggaggataagggcggaagataaggatttgaggcggcaaccccgaaaagaaaaagggccattatcacgattcggcaaaacgttattggcctgccaaacatctattgacctgccaaacatctattgacctgccaaacatctattgacccgctaaacagggcaggccaatagaattgacgggcggatgttaatttagtgagttattagcacctgtgggtttacacagttctcttttaccgtgccggtgagggcattgatgaggttatcaactgcacaagccgccatgttgtagcgggtttcatgggtggcagaaccaatgtgtggtacagcaaccacattacgtagcgtcaggagtggcgaatccacaggcagcggctcttgctcaaagacatccagccccgcggcgtggatcgtaccatcttgtaaggctgcaatcagcgcctgttcatccaccacgggtccacggcccgcattaatcagaatggcactggatttcatttttgccagttgttcacggccaatcatatgataagtctgttctgtcatcggcaaggtaatacacaggaaatcggcctcagctagcagggtatccagtgagcagtggcgggcaccaaaacgctgttctgctgcttcgtgggggcggcggctggtgtacagcacgggcatactgaaaccaaaatgtgcccgttgggctaacgccatgccaatacggcccatgcccagaataccaatggttttatggtgaacgtcaacaccgaaccagtcatcaccaatgctctcttgccattcaccggctttcacccgctccgccagttcaaccacccgacgcgccgtagacaacatgagcgccatcatggtatcggccacggtctctgttagcacggtgggcgtgtgcatcagtgcaatgccccgttgactcagggcttcaacatcgaaattgtcataaccgacagaaatggtggaggcagcccgtaaatttggcgctaattgtaaaaagtcttgatcgattttaccgccagaaccaattaatccttccgcttgttgtagggcagctaatagctccggctgattatccggtgttaagccatcaaaactgtttacggtaaaatgttgtgctaaacgctgatgcagatcggtgggaatacttttgtacaacacaatagaaggtttcatcacacactccagccagttatacccgtcatatttcaaattacctgtgcgttgtcatcccagtcagtgacttaatgtcagttcttggggggcgcttagttgccaccttgctgtaactcgcattatttaggtcatatcgaaatttagggcatatcgaattatttagaatacaacagtaagaacccaaattattagataagaactcaagccagcataacagtgatcatgaccttgggatcaagcgctaatcatcactaaaatgtgatgattgatgaaaatacccatcgatttaccgatggcttcgcagtttacgggcggaggtatcaggctttttcacctcctgcgaagcgtgtcgctattacgttgattttgttgcgatggcaaagttaaacaagtaaggtcttggaataaatgagccagcgactttttagataaagaatacatgttagataaataatgcatgttagataaacaatacatattagataaacagtgcatgagccaaaaataaaaaatgtttcagtaataccggggaagagatgaatattgatcatggggcccgccagccacaatcagtcggtgaacggctactgctgctgctcaaaactcacggcccgctacaagcaggtgaggcggggaacattttgggcaccaccggtgaagcggcgcgtcagcagtttgttaaactggccaaaaaagggctagtggtggccgaagcacaaacccgcggtgtggggcggccaattcagttatggcaattaaccgagagcggtaatacacattttcctgatgcccatggggagttagctgtgcaacttttgcgcttaattcgtacacaattgggcgataacgcactggaattactgatcgatagccgtgaacaggaaactcgcgatcaatattgtcaggcgatggtcggggtcagtaatgtggctgaacgcgtcgagcggttggtggctatccgcaccggtgaaggatatatggcacaatcgcaggtcgaggccgatggcactattttgttgagcgagaatcattgccctatctgggcggcggcggccagttgccagcgtttttgccgtaccgaactggcggtattccagcaagcattgggcgtgccggttgagcgggttgaacatattttatctggtgctcgtcggtgtacttaccgcattcaccccgaataattatgatgaccgggagcttgtcgccaggggaaaatggggagcagtgcggataagccaaaggacattatccgcatgttttatcacggtgtttactattgatatttatcgcattaatgcatattgccgttgtttacagtgggcttaaggtgatttcaacccggcggttttgcgctttaccggcggcagtactgttagacgcgactgggttatcggggccagcgccataagtgcggatacggttggcagcgacgccctgcacgatcagtgcgctcgccacattatccgcccgctgttgcgagagcacgatattatgggcgcgggcaccagtactgtcggtataaccggtcacattgaccgcagttttatcatactctttcaataccatggcgacgccagtcagggtattggctccggcaggtttcaggttactgctattggtatcaaaggtaacgttattcggcatattcaagacaatgttctcgccctgacgggtgacgcttacaccggtaccgctcattttttcacgtaatttggcttcctgcacatccatgtagtacccagccccaccccctagtgccgcgcccgccgctgcaccaattaatgcacctttaccacgatcatgtttagacgatgacaacagaccaattcctgcccccagcgcggcaccgataccggcaccataacctgatttaccggcttgcgactcaccggtataaggattcgtggtacaggctgagaggatcagtgcgacggagacgatggccacaggagccagaatacgttttttcatgatatgaccttaaatgacactctatttcggcgaagagatgacaacgtcgctaaatagcggataaaaaattgattaacccaacgttaactacattggctaatattgatgtgccatcgttatccagtaaaaggtcagcgaataccattgagaaaactcttatagtgctgcccgattgacggaagcgctggttttctcgacaaatctcgcataagagcacgctatggcaatgaaaaaatggctattacgtacaaaagtgcggttattacggccagcacgtaactcttgccatcatgcctcttatttttttgcggtatgaacagtgcgttgcgatatgaataaaaaaaccataaaagacgggttaatgtgcgggatgttgccaatgcatcgtgaggattgtgccctgagtttctgcgtgataagcccgcccgatgaccgtaaaaccttgtttacgatagaagcggtaggcgcggcggttttgctgatacacctccagactcagcgctgggtagcgttgctgaacgtggtccatcaaggccttggcgacaccgtggccgtgaaaggcttgggcaacaaataacgccccgacaagttgttcttccaggatactgataaacccgataatcgtgttttcctcagtggccgctcccggttgctgatatacccaggtacgtgctgtcggaagataagtctctctgattaatggtgcgctctcatgccagtattgctcggcaacaaaagggtgcgcgtcaatcgtactggttagccacagttgcatcagggcattgagatcgtcgggttggtagattcgaatcatttcactgcgttatctgggtggcaaaaacaatttgccatgtgatcgttcaccaagccgctggcctgcataaaagcataacaaatcgtcgagccaatgaatttaaatccacgttttttcaaggccttagacatggcatcagagacggcggttgttgccggggcttctgccagacaccaccaatggttaatttttggctcatcatcaacaaaactccagataaagcgtgagaagtcttcgccgttggcttccatcgctaaataagcctgtgcgttggtaatgatggcttggattttaccgcgatggcggataattccgctgtcttgtacccgtatttctacctcttcaggccccattttcgccaccttaaccggatcaaaatgatggaagcttttgcggtaatgctcccgttttttgagcacggttatccatgacagccccgcttgttgcccttccagacaaatcatttcaaacaatgcccggctatctttgagtggcaccccccattcggtgtcgtggtaagccagataaagcggatctgaggtaacccaaccacagcgttgcaagctcatatttatctacctttttgttgtttgttatggtgcttgtcgtttgttatagcgtttgtcgcttgttatagcatcggtgtcgcttgtgataatcggtgtcgcttgtgatagaggaggatgatcgctgttcaggcaaagataagcaacctgctcatgtctattctgcagtggctttgagacagggctaacacggttagaaatggtgaaatttaaaccaacttttcccctcggcgacccataaattaaacctgattgcagcatcttaccggattctggctgtatatcttacggtcaacgggtatactgacccattccattttaatccacttgtatcgcgtgcgaatccaacatgcaaaagtttgataccaagacctttcagggcctgatcctgacgttacaggactattgggcgcgccaaggctgcaccattgttcaaccactggacatggaagtcggcgcgggtacctcccacccaatgacctgcctgcgcgcaattggcccagagccaatcgctgctgcttatgtacaaccctcacgccgcccgaccgatggtcgctacggtgagaatccaaatcgcctacaacactattatcagttccaggtgatcattaagccttcgccagacaacattcaggagctgtatttaggctcgctgaaagagttaggtctggacccgaccatccacgatattcgtttcgttgaagataactgggagaacccaacactgggtgcttgggggctgggttgggaagtgtggctaaacggtatggaagtcacgcagtttacttacttccagcaagtgggggggttggaatgcaaacccgtcaccggcgagatcacttatggtctggagcgtttggcgatgtacattcagggcgtagacagcgtttatgacctgatatggtgcgacggcccgctggggacgaccacttacggcgatatttatcatcagaatgaagtggagcaatccacctataatttcgaatacgccgatgtcgatttcctgttctcctgctttgagcagtacgagaaagaagcgcagtccctactggcgctggaaaccccactgccgctgcctgcttacgaacgtattctgaaagcgggtcatacgtttaacctgctggacgcccgtaaagccatctcggttaccgagcgccaacgctatattctgcgcatccgtacgctgaccaaagctgtcgccgaggcatattatgcctcccgcgaggcattgggcttccctatgtgcaaaaagaatcagaactaagaggctgtcatgactcaacagactttcctggtggaaatcggcacggaagagctgccgccgaaggctcttcgttctctggccgaatcttttgccgctaattttacggctgaactggataacgctaatttgtctcacggtgaggtgagttggtacgccgcgccgcgccgtctggcagtaaaagtggccaatttaagtgcggctcaggctgatcgtgaagtcgaaaagcgcggcccggccattgcgcaagcgtttgatgctgaaggtaaacctagcaaagccgctgaaggttgggcgcgtggttgtggtattacagtcgatcaggcggagcgtctggtgacggataaaggcgagtggctgctgtaccgtgcccatgtcaaagggcaacccgcccaattattgctggcaggcatggttaataccgcgctgagtaagttgccaattccaaagctgatgcgttggggtgataaagaaactcaattcgtccgtccggtgcataccgtgaccctgctcttggggactgaagttattcctggcaccgtgctgggtatcaattcagatcgggtgatccgtggccatcgctttatgggtgaagcggaattcacgatcgacagtgctgaccaatatccacagattctgctggagcgtggcaaggtcattgctgattatgaattgcgtaaatcaatcattaagcgtgatgcagaacaggcagcgcaacagattggcggtgttgctgatctgagtgaaagcctgctagaggaagtggcgtcattggtggagtggccggtggtgctcaccgccaagtttgaagagaaattcctggctgtccctgcggaagcgctggtgtacaccatgaagggtgatcagaagtatttcccggtttacgatactgccggccacttgatgccacacttcatttttgtcgccaacattgagtctaaagaccctcaacaaatcatttctggcaatgagaaggtggttcgccctcgtttggctgatgctgagttcttctttaagaccgaccgcaaaaaacggttggaagataatttaccgcgtctggaaaccgtgctgttccaacagcaactgggtaccctgcgtgataaaacagatcgtattcaggcgttggcgggttgggttgctgcacaaattggcgctgatgttaatcacgccacccgtgcgggtctgttgtccaagtgtgacctgatgaccaacatggtattcgaattcaccgatacccaaggcgtgatggggatgcactacgcccgccacgatggtgaagctgaagacgttgccgttgcattgaatgaacaatatcagccacgttttgccggtgatgatttgccgtctaacccggtcgcttgtgcgctggccattgccgataagatggacacactggcgggtatcttcggtatcggtcaacatccgaaaggcgataaagatccgtttgctctgcgccgtgcggcgttgggtgtactgcgcattatcgtcgaaaagaatttgtcactggatctgcaaacactgacggaagaggcggtgcgcctgtacggcagtaagctgaccaatgcgaaagtggtcgatgacgtgattgaattcatgctgggccgtttccgtgcctggtatcaggatgaaggtcatagcgtcgataccattcaggcggtattggctcgtcgtccgaccaaaccggctgattttgatgcgcgagtgaaagcggtgacctatttccgcacactggatgctgctgccgcattggctgctgccaacaaacgtgtatcaaacattctggcaaaatccacggataccctgaatgaccatgttcatgcttctatcttaaaagaaccggcagagctaaaactggcgacacatttggtggtattacgcgatcaactggagccggttttcgcggctggtcagtataaagaggcgctggttgaattagctgcgttgcgggaaactgtcgatgagttcttcgagagcgtgatggtgatggctgaagacgatgctgtgcgggttaaccgtctgacattgctgagcaaactccgcgaactgttcttgcaggttgctgatatttcgctgttgcaataactcgctcgataacatcgtgctgggcaataaggggagctatacgctccccttcagactgctgacaaaccccgatgacgcgatcttgaacggtgaggataggcagaggagtaaagcgtccgcgccaaggatggcgcggctcgagcctacatggatgtatttacggcgtctttacgatctgcctgttctctccgtcgcgggcactttgtcaataacctcaaggggagctatacgctccccttacgttatgtttttgtggggttagcgacgcgcccttggcttacgttaacgaatcggggttcgtttgcgggctctccctgcaacctcccgtgctttgggtatatactcattaagattttatccaatagcgattttatctaatagcgattttatccaatagattgtgtaccgcacggattggatgctaagaacgggattttgtgagagtaaatagtttattaaggagtgattgcacatgatttttgcattgaacaccgtccggaacccacgctggctggcacctttattggcgttcttggtcatgttcttggtgaccgcctgcggagataaagagccagaacaacgtaaggcttttattgattatctgcaaaacaccgtgatgcgcagtgggatgaaactgccaacactgagtgaagaccaaaagcagaagtttggcccttatgtcagcgactacgcgattttagtcactttttcacagcaattgagtaagtcagttgatgccagtctggtcccggctattgagcaaatcaatcaaatccgcgtggcacaggattacctcagtaagcgtgatgcgttacagcagtctgcgggtgcgctgaacctgttagtgcaacaaatccgcactgccaaagctcaagctgacagcgcccaagccgcattgaagctgccagatgacttgaaagtggtgttcaacagagcctttgataacattgtgactcagcctgctaatgtgttgattccagcagtgccggtggtctcttcatttgtgcaagatctggttcaggttggggatttcctgcaacagcagggtacgcaagtgacctttaataacggtggcattcaattccagactccgcagcaagccgctcagtacaacacgatgatgagtaacttggtcgccaagtacccggagatgatggccgcgcaaaagcgcgtgatgaaggtaatgcagtaatagatgttgttaaatagaatttgcgtattgcgaaggcagactgctgacaaaccccgatgactcaatcttgaacggtgaggataggcagaagagtaaagcgtccgcgccaaggatggcgcggctcgagcctacatggatgtatttacggcgtctttacgatctgcctgttctctccgtcgcgggcactttgtcaataacctcaggggccttttggtccctgttattttcttacatattcctctctagcctaaaccacgatagcgcgatctttcggatgaatgtcggcttctcctcctacgagcaaaaataacttgtgacaaatgtcacattttaaaaacaaacaaccgatcatcaatagtgacataagtcacacttgattggttttttagctcaataattctgcgttgtgactttattacagcctaaagatgtgatcttaatcaacaaatacaccggtgtgatgggttgttttgtgtgactttcgtcacgaaattttcgtgagctacgcgtggctaaaagagcatgctagagtttgttttgcatacagcgtgtttgcataaggtaacactggcgggttttgcaaaactgcctccaattaaaataattatatcgcgctcttattgttagcgcgtaccaataggggtgttttatgttttcaccagacgcaaaggtcagggtccaaaactttggccgattcctaagcaatatggtcatgcccaatatcggcgcatttatcgcttggggcattatcaccgcactgtttattccaaccggctggctgcccaatgaaaccttagccaaactggttggcccgatgattacctatctgttgccactgttgatcggttttaccggtggccgtttggtaggcggagatcgcggtggcgtagtcggtgccatcaccaccatgggggtgatcgttggtgcggatatgccaatgttcctcggtgcgatgattgtcggcccgctgggtggctgggcaattaaacattttgaccgctgggttgaaggtaaaatcaaaagcggctttgagatgttggttaacaacttctcatccggcatcattggtatgttgctggctctccttgcctttatggcgattggtccgttggttgaagtcctgtctaaagggctggcttacggtgtggatgtcatggtgcagaataatctgttgccactcgcatcgatcttcgttgaaccggcaaaaattctcttcctgaataacgctatcaaccacggtatcttctcaccactgggtgtccagcaagccgctgaaaccggtaagtctatcttcttcttgatcgaagcaaacccaggaccggggttgggtgtgttgatggcgtatatgttcttcggcaaaggtaatgctaagcagtcagctggcggtgccgctatcatccatttcttcggtggtatccacgaaatttatttcccttatgtgctgatgaaccctcgcttactgttggcggtgattctgggcggtatgacaggtgtgttcaccctgaccctgctgaacggcgggctggtctctgccgcttcaccgggttctattctggcaatattggccatgacgcctaaaggggcttactttgccaacattgctgcggttgccaccgcctttgccgtgtccttcgtggtctctgccatcttgctgaaaagctctaaggctaaagacgatgaagagggccttgaaggcgcaactcgccgtatgcaagatatgaaagcgcagtctaaaggtgttcaggcggccaatgccgctgccgctgctggcgatttaagcacagtgcgtaaaattatcgttgcctgtgatgccggtatggggtccagtgcgatgggggccggtgttctgcgtaaaaaagtacaagatgccgggctgaaacatattgcggtgaccaactgtgcaatcaacaacttaccggaagatgtggatctggtgatcacgcaccgtgatttgactgagcgggcgatgcgccatgcaccgcaggcacagcatatctcgctgactaatttcctcgacagccaactgtacaacagcctgacggcggagctgctgcaagccagtcaattggttgataatactaaagtacagaaagtgatcgaaaaactggacgatagcttcgaagcatttgaagataatttgttcaagttgggggcggagaatatcttcctcaatcagcatgcgacagccaaagagcaggctatccgcttcgccggtgaacagttggtcaaaggtggctatgtcgaacctgaatatgtcgaggcgatgctggatcgtgaaaaactgagctcaacgtatctgggtgagtctatcgcggtgccacatggcacgattgaagcaaaagatcgtgtgctgaagaccggggtggtgttctgtcaatacccggaaggtgtgcgctttggcgatgaagaagatgatatcgcccgtctggtgattggtattgctgctcgtaacaacgagcatattcaagtcattaccagcctgactaacgcactggatgacgactcggtgattgcgcgtttaagtaagacgaccagcgtgcaggaagtattggacttactgggcggtaaaacgtctgcttgatatacccgtcatacttcacgctgcatgaacgttggctgctttgcctacctgcaacgcgaattatttagcgtataaacaagtcataactgctagggctgttggaagaaaatggcccttttacagcaaggtaacgaatatgaaagcattacattttggcgcagggaatattggccgtggcttcatcggcaaactgctcgcggatgccggtgcgcaactgaccttcgccgatgtgaatcaaccgttgttggatgcactgaataaacgtaaaagttatcaggtcaatgtggtcggtgaacaggctcgggttgaagaggtaaagaatgtcagtgcggtaaacagcggtagcccggaagtggttgcgctgattgctgaggccgatattgttaccaccgctgttggcccacaaattttggccagaattgcggcgacagtggcacagggtctgatcactcgacatcagcaagggaatacccgcccactgaatattattgcctgcgaaaatatggtgcgtggcactagccaattaaaacaacatgtgtttgctgccttatcagaagacgaacaaagatgggtagagcagcatgtgggttttgtggattcggcagtcgatcgtattgtcccaccatcagaagcgggcagtactgatatcctggctgtcacggtagaaacctttagcgaatggatagtcgacggtacccaatttaaaggccagccacccgaaatcgtgggtatggaattgaccgataatctcatggcttttgtcgagcgtaagctcttcacgttgaacaccgggcatgctattaccgcgtatctgggccaactggcaggccatcaaacgatccgcgatgcgattctcgacccggcggtacgtcaaacagtaaaaggtgcgatggaagagagcggtgcggtactgattaagcgttatgctttcgacccacagaaacatgcggcttatatcaacaaaattctctctcgttttgaaaacccttatttgcacgatgatgtcgagcgggttggccgtcaaccactgcgtaagctgagcgccggtgatcgtttgatcaaaccgctgctaggcacgctggagtatcaattgccgcacgattctctggtaacgggtattgccgccgccatgagctatcgcagtgagcaagatccacaggcccaagagttggtgacgttattggcacaattagggccgaaagctgcgttagcgcaaatttcagacttgcctgctgatagtgaggttgtcgaacaggcggtgagtgtgtataacgccatgcagcagaagctggcacactgattttagtgactaagccagttatgtcccattggcctgacaacggaaacgatagcgggccaatgatttaagacactaaagtatttgccaacggatgatttgtccgctgcggcagaggaggaataccgtgttaaatttatgcggtgtttattttgccgtggcgtcataatcaggcggacaggacttcaccaacttcccagtgactagcaatgattgaaaaaaaacaagcatttgagaatcgggttcttgaacatttgaacgctgggaagaccgtgcgcagcttcttgatggcggcagtcgatttattggctgaagcactgaatatactcgtggtgcagatttttcgtaaagatgactatgcggtgaagtatgccgtggagccgttattggtcggtgacgggccattgagtgaactctctgtgcggttgaagctggtttatgcccttggggtgatcacccggcatgaatatgaagatgctgagctattaatggcgctacgtgaagagctaaaccacgatggcactgagtatcgctttaccgatgacgaaatcctcgggccatttggtgaattgcattgtgtcgatgaattgccgccagtacccacttttttacgccctgatgaagccgatgcttcgctgattgctatgcaacgccagcgttatcagcaaatggtccgctccaccatggtgttgtcgatcactgaactgctctctcgcatcagcgtcaaacaggtctctaagctctcgccattaagtcaaggttaatcaagaaattacgtttagccactcttctacctgccgtcatactgctatccctttaatcgccgctatactgaggcattgatgcgggttgggctggccacctgtgaaattctgccggaacggcgtggcaaccgcggcaagagccagtggcttagtggaatgcatctctgtcttgatacacaatcagtgttattatatctctaactttagtgaaatatcgtgcccatcagaggcatgtacggaccaatattatgaaagaacatgcagaaatcaaacgtttaagcgatatgctggatgcgctgaaccacaaagaccctacggtgatccaacagggtaatgtggagctaattacccagcatatgaaagaaaaagagaaactggccgctgaaattcagcgcctgaaagaagtacgggtaaaaaacctgagtgcagaagctcaaaaactggctcaactgcctttcagccgtgctattaccaagaaagagcaagcggatatgggcacattgaagaaagcggtgcgcggtattgtggtggtgcacccaatgacggcattaggccgtgaaatgggcctgaaagaagtgacaggctacgctaaaaaagcgttttgatcgccgctttgcggtaacctctgggtggcatggccgccacccggtgtgttgttccttttgcgcctctctctctcccttaagtgtaataacggttttgccttcgttaatacaatacgaccgtaaaagcagcgaactcatgaaactcaaaagctacctgatgttcactacttgtagctggcagagccaataaactgagaaaatgtttcgcaccatatttgtacggttgtgtaatcgtccggattgacgcctgcgggtaacgtctttttgaagttaccaaaatttttcaagtcaccaattaattttgcatcatccttaattttaagaaatgattctttatcatccgcctgtgttttcgtcagatagattttgtaatcaggtcctggtgcaatttctccttcaaaggcaatttcgtgttctgatacatacagttttccttctgcccagtgtacggcatcacttcctttctggttgcgactaaactcaccggtatattttgcagattgctttactgcttgtatctcaggtgctgtcgcgttagtttctgcggttaatattggcaagatataaatccccaatcctgttcccgcaccgaatacggcaagatgtgtcactaacattaaagctttcattcgatttgtcataaaaaatagctctcggataatcttacttaacctcttaggccgggtgtttactcctttggtcccagaccgtcagtcagtattttcatcatgagtcagcgcggtgcctatcatccctgcggcgataaatttgaacctgtaagataaaagtgaacactataaagtgtggccgtggcatcgcgcagtgttcgctaaaaatatatagcgtaggctatttggtcatgcaatattattttttgcgtgttcgataaaaaataattatacagttcattcataatctgttaattaatcaaggttttcacaataaagaaaagaaaaattcagggcatccccgtttgctaccggagtaagcaggagtagaagtaatgtttcaggtttttgctcggaaaggatacaaggctgctgccatctccgatctggcgaaagtgccaaccagccatactctatctcgctttgggtagccaagagggtatgtatctggcagcacaggctgtgcgtgtactggatgtttttgatacaaaaaccgtcagtatctgctagaaatcataatcattaataacgtctaaaagatcctgtctttttttgtatttaacgcttaatttttcttgcaaactacgtgctttgctacacgtgacattcacttttttttctatttcaatctgtcgttctttaggcagcgttgagtcccactcgccagagaaatattggcagtcatctgctacgtttaaataggccgtgatatctaccggatatttttcagcggcatgagaataccccagtaaaataaaaaatggcatgataaagaatattatttttttcatactatcgaccgtccgttgagcaatgggggttatctttttaaccgccatggtgtttgattacaccaaagctattacctactacatgaagatcggcgttcataccatcttttttattggatgttgaactcaatgtttgggtcgaagaaattccctgaaaacgagaaacctatttatcgccaattatttctgaggatggcagaaataaccgttgtggctattcctgccaatattgagggattagaacgtttcccagctcttctgctggttgatccgatggtcttctggcgtatgacgcccgttagaggcttttggcgtcacaacacggccttcatctgtcgcgccttcatcttcagatagccgaaacaccgccacagcctgagccagcaagatggcctgctcagccagtgagtcagcggcggcggcggattcttccaccaaggccgcattttgctgcgtggtactgtccatttctgagatagccaagctaacttgggtgataccacggctttgttcatcagatgctgaggcgatttccgccatgatatcgcgcacgtggctcacggagcggacaatctcctccatggtgttaccggcatttttcaccagcgatgttccggcattaacctgagaaacagactcgccaatcagcccttcaatttctttagcggcctgcgcactacgttgtgccagatttctgacctcactggcgactaccgcaaagccacggccttgttcacccgcccgggccgcttcaacggcggcattcagcgccaaaatattggtctggaaagcgatgctgttaatcactgaggtgatttcagaaatacgtttggaactgccagagatatcattcatggtgcgcactacatcattgaccagcttgccgccctgttgtgcggtctgcgaggcctcggtggccaattgattggcgtgatgagcgttatccgtgttctgttttactgtggcgtttaattgttccatgctggcggcggtttcttctacggcggcggcttgttgctcggtacgggacgataaatcagtattgccagcggcaatttcaccagaggcatgggatacctggctgacaccaatgcggatttcatcaatcatggcacgcagattttcattcatgcgggcgacggcattcatcaacatgcccagttcgtcggtacgggatgatgtggttgccgcggttaaatcgccagtggcaatacgttctgccatatccagtgtggcacgtagaggcacggtaatttgacgggtcatgcgccaggcgatcaatagccccaaaagtaaggccacaaaagccgcaatagcgagttggtactgggcattgttaatctcgttgtgcgtaccttgcaactcttgggtaaacagttgggtggccaacgtattcaatgcattcgcactggcctccatcactttaccgacctccagttcttgctgataagccggtaaataggccagaacgttgtctttatagagggctaggttagcggcaaccggtgctaatagtttctgctgctcggcagataacacaggcatgaaagcattcgcggcactgttggcaatgttaattgaggttatcagtgcagtttcggcatctttattgcgatccagtaataaaccgcgcgcgttgtaacgcaccgtcattaatttttggctcatttctgctagcaatatctgcgtattggtatcggccccttcattaagcagactttgctgtagtgcattgatattatttaggctttcagagatgctccagctttgacgcactttatctttattggtcaccgcattcacaaagttcgtctgttgttgctggtactcctcaacgacatgattaatgttggcaatatttttgcggttatcaactgaccagcggagatttgcactttgggtcagtaaattttttatattattgatgtgctgtgtgttttctgtgatgtatttcaggtcataggtacgttcataaagtgcgcggttatattttgcctgattcgcttcgttgttgattttgtagctcaactccactttatatgcatgttcttcgatcacggagaagtgataagcggtggtgcccgcaatgaccccgaccaatagcaacattaggaaaaaacttaaacccaatttttttccgacttttacgttatcaaagctgccaataattttgctaaataccgccatgttcttctccgttatacggtgtttctgatatgaattaatcagcgtaggtgagtttggtaaggtctaattattagagaagttaaaggactggtatgtacgcggggcagccttggcaagagtgcttttcccaaacatctttttttctacatccatgcattgtgatcatggatgccagtaaccttcttgtatgctctatcggcaggagttgatgaaactttaacaataaaaatgccagcaagagggccttgctggcatgtatctttcgtacttgaagcttacctgcaacgccacgttctttggctatgcaacaggcggtttaaggcccgttttatggataagcgaattacttggcttgagcgaaacgcgctgcagcttcgtcccagttaaccacgttccagaaggctttgatgtagtctgggcggcggttttggaatttcaggtagtaagcgtgttcccatacgtccaggcccacaatcgggaaacctgatacgccagaaacggcttcgcccatcagcgggctgtcttggttagcggttgaaacaaccgccagtttgccgtcgtctttcagtaccagccaagcccagccagaaccgaaacgggtcgcagcagcttgttcaaatttttctttgaagctgtctacgctgccgaaatcgcgctcgatagcggctttcaggtcaccggctagggtggtgcccagtttcaggcctttccagaacagactgtggttagcgtggccgcctgcgttgttacgcataaaggtgcgcttttcagcagggactttatccagatctttgatcagatcttcaacgctcaggtccgccagctccgggaagctctccaacaccgtatttgcattgttaacataggtctgatggtgtttggtgtgatggatttccatcgtctgcttatcgaagtgtggttctaaggcatcataagcataaggcagtgatggcagtgaataactcataatcatcgtctccatagtgtaggacggtgcaaaaaagtaagcaccgcgtaagcatggggatcattatagttaattaaatgatattgaaaatgattatcaaacctatatttatagtgtggtctttgggtggcactgaagaataaaatgggtcaataatatttttataaaattaatttatgatgcggcgtaacccgcttctttttgacgttttacgcttaaaataacccacttgtcagtggccgtatcttcacggtaaaaaatgaggtctccactattagcgaaattgacaacgatcagcaaaattgacaacgatcagcaaaattgacaacgagctcaagtctgagtgtggtcgtcggtcactgagaatttgacatcaatctcgccactatcgttatatctttggtgtcaccaatgatattttttggtgtggattgtcgatcaatcgatctcttttattttattctctgcggatgagtatacaccgtcgcccgccccggtttactgaaaccgactaacgtcaaattgcagcgctcggcaacttcaacggcaagcgtggtggcggcggagacggcaaataaaatctctgcaccacacatggccgttttttgcaccatttcataactggcacggctggaaaccagcaccgcaccttgttgccacggctgttttgctcgtatccccagtagcttatccagtgcaacatggcgacctacatcttcgcaaccgcctaataactcaccttcaggattaatccacgcggcagcatgggtacagccggtgagttgaccgaccggttgtacctgttttagctgggcaagggcggtatccaaatgctccaagttaaatgcctgggtgaacggtagcggagtgattgggcggaagatatcgtccagttgttcaatgccacaaactccgcacccggtacgccctgccatggcgcggcggcgctctttcaggccagcaaaacggcggctggatagctcaatattgacctctatgccgttgcagccgggggtcatctcaatagcatagatatcctgtgggctgctaatgatgccttctgataacgaaaagcccagcgcgaaggcagccaaatctttaggggttgccatcatcaccacatgggagatgccgttgtataccaatgcaacgggtacttcttccgccagccaatcctgctgtggttctgccaatttatgccgctgtagcacgtcaagctgccgggcaccgcggatttcggcgctagaggataatctcgaaggtttgatctggctcactatgcggtcctgaaagttataacccataatcacaatgtggtaacattcacattaagaatggtgcggctatgtattatctaacatagaaattcattccacacagaaaaagcgtgatatcgcatgagcgattttagcgcctcccattttattgagggaagcgtgaactggaaataatgtgacaatgaaggagatacccatgcaggtcagcagaaggcagttctttaagatctgcgctggcggtatggcaggaacaacggtcgcggcactcggcttcgcgccgtcagtggcgctggcggaaacgcgcaattataaattgctgcgcgctcgcgagacacgtaacacctgcacatattgctctgtcggttgtgggcttttgatgtatagccttggcgacggcgcgaaaaatgctaaagaaagtatttttcacattgaaggggacccggatcatccggtgaaccgtggcgcactgtgtccgaaaggggcagggttagtcgactttatccatagcgaaagccgcttgaaatacccagaatatcgagcgccaggctcagacaagtggcagagaatcacttgggatgatgcgtttacccgtattgccaaattaatgaaagaagaccgggacgctaacttcattcagaccaacgatgccggtgttaccgtcaaccgttggttaagcaccggtatgctgtgtgcttcggcctcaagcaatgaaacgggttatttgacccaaaaatttagtcgcgctctcggcatgcttgccgtagacaaccaagcacgtgtctgacacggaccaacggtagcaagtcttgctccaacatttggtcgcggtgcgatgaccaaccactgggttgacattaagaacgcggatttaattatcgtcatgggcggtaatgcggcagaagcgcatccggtggggttccgctgggcgatggaagccaaaatccacaacaatgccaagcttctggtgatagatccgcgctttactcgtacggcatcggtggctgatttctatacgccaatccgctccggtacggatattgcgtttctgtccggtgtcttgttgtacctgatctccaacaataaaattaaccgtgaatatgtcgaagcctataccaacgccagcttgctggtgcgggaagactatgctttcgatgatggcctgttcagtggctatgacgccgaaaaccgtcaatacgataaaactagctggaactatcagttggatgaagacggttttgctaaacgggatgtcacgctgcaacacccgcgttgtgtgtggaacctgctgaaagagcacgttagccgctatacaccggaagtggtctccaatatttgcggtacgccaaaagacgatttcctgcaggtttgtgaatatctcgccgaaaccagtgtatccaataaaacggcgacgttcctgtatgccttgggttggacgcagcactctgtgggtgcgcagaatatccgtactatggcgatgatccagttgctgttgggcaacatggggatggcaggtggcggtattaacgccctacgcggtcactccaatatccaagggctgactgaccttggcctgttgtcgcaaagcctgccgggttacttgaacttgccgtcagaaaaacagccggatattgatacctacctgaaggccaacacgccgaaaaccctgttaccaggccaggttaactactggagtaattacccgaaattctttgtcagtttgatgaaaagtttctacggtgataacgcccaaaaggaaaatggctggggctatgactggctgccgaagtgggataaaggctacgacgtcttgcagtatttcgaaatgatgtcgcagggcaaggtcaatggctatctgtgccaaggctttaacccgattgcctcgttcccggataaaaacaaagtgacagcggcgctgtcgaagctgaaattcttggtgacgattgatccactcaatactgaaaccgcgaatttctggcaaaaccacggtgaatttaacgatgtcgatccatcgaaaattcaaactgaggtgttccgcttgccatccagttgttttgctgaagagaacggctcgatcgttaactccagccgctggctgcaatggcactggaaaggcgctgattcaccgggagaagcactgaacgatggtgcaattctggcgggcatctttatgcgtatgcgtgagatgtaccagcgggaaggtggcgcggtgcctgagcaggtgctcaatatgacctgggactacctgacaccagaaaatccagagccggaagaagtggcaatggaaagtaatgggcgagcgctggcggatctcactgatgccgacggcaaagtgttggtcaaaaaaggcgaacagctcagtaccttcgctcaactgcgtgatgacggtaccacttccagtggttgctggatctttgcgggtagctggacaccggccggtaaccaaatggcgcggcgtgataatgcggatccatcgggtctcggcaataccttgggctgggcctgggcatggccgcttaaccgccgcattctgtacaaccgtgcgtctgctgacccgcagggtaaaccgtgggatccgaaacgccagttgctggagtgggatggtgctaagtgggccggtattgatgttgctgactacagtgctgcggcaccgggcagtgatgttgggccgtttatcatgcagcctgaagggatgggccgtttgtttgcaatcgataagatggctgaagggccgttccctgagcattatgagccatttgaaacgccgttggggaccaacccgctgcatccgaatgtgatctctaacccagccgctcgtgtatttaaagatgatctggccgcgatggggtcgcacgagcaattcccttatgttggcaccacttatcgtttaaccgaacatttccactactggaccaaacatgcgttgctcaatgccatcgctcaaccggaacagtttgtggaaattggcgaaaaactggcggcgaagaaagggattaagcaaggcgatacggtgaaagtcagctctaaccgtggctttatcaaagccaaggcggtggtgactaaacgtattcgtactctgaatgttcatgggcaagaagttgacaccattggtattccgatccattggggatacgaaggggtggcaaaaaaaggcttcctggcgaataccctgacaccgtatgtcggtgatgccaatacgcaaacgccagagttcaaggcgtttctggtcaatgtggaaaaggtgtaacggagagaatctatgtcactgcaaactcaagacattatccggcgctccggtactaattcccttacgccgccacctcaggtccgtgatcatcaggaaccggtggctaaacttatcgatgtcaccacctgtatcggctgtaaagcctgtcaggtggcgtgttcggagtggaacgatatccgcgatgaagtcggtcataacgtcggggtgtatgacaaccctgccgatttgaccgctaagtcgtggacagtgatgcgtttctctgaagttgaagatgaagagagcggcaagctggagtggctgatccgcaaggatggctgtatgcattgcgccgatccgggctgcctgaaggcatgtccatcggaaggggcgatcattcagtacgccaacggtatcgttgatttccaatcagaacattgtattggttgtggctactgcatcgcaggttgtccgttcgatgtcccgcgcatgaataaagatgacaatcgggtgtataaatgcaccttgtgcgtcgatcgtgtcggtgttggtcaggaacctgcttgtgtgaaaacctgcccgactggagcgattcactttggtaccaaagagtcgatgaaagaagtggcggctggccgggttgctgagctaaaaacccgtgggtttgataacgcagggttatatgaccctgcgggcgtcggcggtacccatgtgatgtatgtactgcatcatgcggataaaccccagctttatcatggcctgccggagaatccgaccatcagtccgacggtgactttctggaaaggcatctggaaaccgttggctgcggtaggtttcgcggcgaccttcgctgccagtatcttccattacgttggcgtaggcccgaaccgggtggaggaagaggaagaagacgatgagacaacggatcctaccccttccgagacggtagcaaaggcaccagagcagacaacctctgagcgctcagacgaaggggaaacgcggaaatgaaaaaagaaaaaccgatccagcgctacagcgcgccggagcgcattaaccactggatagttgccttctgctttatattggcggctatcagtggattagggttcttcttcccttcatttaactggctgatgaatatttttggtacaccacagatggcgcgcattcttcacccctttgccggggtggtgatgttcgcggcctttttgatcatgtttttccgctactggaaacataacctgatcaataaagacgacttggagtgggccaaaaatatccataaaatcgccatgaatgaggaagtgggtgacacagggcgctataatttcggccaaaaatgcgtattctgggctgctattatcagtctggtgctactgttagtcagtggcgtggtgatttggcggccttactttgcgccatccttccctatcccgctgatccgtctggcactactggtgcattcgctggcggcggttgggttgattatcgtgattatggtacatgtgtatgcggccctgtgggtgaaggggacgattaccgcgatggtggagggctgggtacctgcagcatgggctaaaaagcaccatccgcgttggtatcgtgaagtccgcagtaaagatgatgctcgcgccaacgctaaaggccagccgcaagagaaacagaaagagaaaccctgatgagtattcgtattgtccctaaagaccaattaggtaaacaacgcgaaaaaggtacaacggcggggaatatcccgccgttacttttcgcaaatttaaaaagtttgtatacccgacgcactgaacgtttgcagcagttggcgctggacaatccgctggccgattatctggattttgcggccaaaattactgaagcccagcaaaaagcactgcatgaccatccgttggtcttggatatgcaagccgagttggtgcaatcagcggccagtggcaagccccccttggacgggagtgtttttccgcgtaccgaacattggcgcaagctgctatccgcgctgattgccgaattgcgtcacgatgctcccgaccacattttggcggtgctggataatctcgataaagcatcggttcatgagctagagttgtacgctgatgccttgctaaaccgagatttttctcaagtcggtagtgagaaagccccgtttatctgggccgctttatcgctctactgggcgcagatggccagccaaatccctggcaaagcacgggctgaatacggtgaacaccgtcagttctgcccggtgtgtggcagcattccggtttccagtgtggtgcatatcggcacccataatggcttgcgttatttgcactgtaatttgtgtgaaagcgaatggcatgtcgtgcgaattaaatgcagtaactgtgagcaaacccgtgatcttaactattggtcgttggacagcgagttggccgcagtaaaagcagaaagttgcggtgattgtggtacttacctaaaaattctttatcaggaaaaagacccgcaggtggaagcggtcgctgatgatttggcctcattgatccttgatgccaagatggaaggtgaagggttcgcccgcagcagtattaatccatttttgttcccaggtgagtaatacataaccttgctacaatttaccctaaataagtcgagttgcaggaaagccgcactggcgtgagcccccaaaagcccccaaaagcttattgatgtaaggtcaatgaccaatcagtgatggggggtgagggcaatcaacgcacaggcaactcgacgtatggcgggtatatcgtttaattaatttgtttgagtgactatgagcgcagaaccacacccattatatcgccagttaccggccattgatcgcttactgaatgagcctgaaatggcccctttattggcggagtatggccccgttcttttggccgataccctacgtcaattacaggcagaagctcgtgaatatatcggtcaatttcatactctggctgattggtgtgcggactggcctgccgctttacgtcaacgattgaatcaacggcaacccgcgttaaaacctgtgtttaatcttactggcacggtgctgcacaccaatttgggccgtgcaccgctggcagaatctgctatcgcggcggtgaccgatgccatgcgaagtgcggtcaccttggaatactccttagagggcgcgggccgtgggcaccgtgatcgggctgtcgccgatttactctgtgccctgaccggtgcggaagatgcctgtatcgtcaataacaatgcggcggcggtcttcttgttgttaacggtcatggcggcgggcaagcaagtcgtggtctcccgtggtgaactggtcgagattggcggtgcgtttcgtattcctgatgtcatgcgtcaggcagggtgtgatctggtcgaagtgggtaccacgaaccgaacacatctgaaagattatcggcaggccatcaatgaaaatacgggtctgctgatgaaagttcataccagcaattacagtatcgagggtttcacggccgcagtatccgaacagcaactggcggcattggggcaagagtgttccatcccgaccgcgaccgatttaggcagtggttcgctggtggatatgacccgttacggtttacccgccgagcccatgccacaacagttgattgcggcaggcgtagatttagtgaccttctccggtgataaactgttaggtgggccgcaagcggggatcattctcggtaaaaaacagtggattgagcggttacagcaacatccgctgaagcgagcattgcgggccgataaaatgacactggcagctttggacgccaccttgcgcctctatcagcagccagatcggttggttgaacaactgccatctctgcggctactgacccgccccgcctcagagattgccgcgtgtgcacaacgcctgctggccccactgattgcctgttatggcacagatttcactttggatattgaatcatgttggtcacaaattggcagtggttcgctgccggttgatcgcttgcccagttgggcgctgacgtttacgcctaaagatgggcgcggtagtacattggaagccttaacggcgcgttggcgcacactgacgaagccggtcattggtcgtgtggctgatgggcgtttgtggctggatttacgctgtctggaggatgaggcggcgttgctaagggaattggcatcatgattattgtcaccgcaggccatgtcgatcatggcaaaaccacacttttacaggccattaccggggtcaatgcggatcggttgccggaagagaagcagcgggggatgaccatcgatctgggctatgcctactggccacttcctgatggccgtatcatgggttttattgacgtccccggtcatgagaagtttttggcgaacatgttggcgggggtgggcggtattgatcacgctctgttggtggtggcctgtgatgatggcgtgatggcgcagacccgtgaacatctggcgattttgcggctgagtggtcggccagcgctaacggtggcattgaccaaagcggatcgggttgatgatgagcgcattgcacaggtccatcagcaaattttgcaggagttggtggcacaaggctggtcagcggagcagatcagtctgtttgtcacggcggccgtcactgagcgtggtatcggtgagttacgtgagcatctggcgcaatgtcatcagcaacgtgacccgaagggccgattacagcggcgttttcgtctggccattgaccgggtattcagcgtaaaaggggctggcttagtggtgacggggaccgcgttggcgggccaggtggcggtaggcgataccctgtggttgactggcggtgattgccccgtgcgggtgcgaggtattcatgcccagaaccaaccggcacagcaggcgcaagccggccagcgcattgccctgaatatcagcggtgatatcagtaagcagcaaatcaaccgcggtgattggttattggcgcagccaccgttgccaccggtggatcgggtgctggtaaccgttgatgccgatacgccgttacaacactggcagcccttacatctgtatcatggggctcgccatattacgggccgtttttcactgctaggtcaccagcagttaattgacgaccaacaaccgttaattgacgaccaacaaccgttaatcggccatcaacaaatcataaataatcaatccacatcaggcggtcattcctctcagattctggccgagttgctgctggacagccctctgtggctggtagaaaacgaccgggtgatcttgcgtgatatcggggcgaagaaaaccttgggtggcgcacgggtgattcatctggcggtgccatcacgtggtaaacggcaaccggcgtatctggcttggttaaccgcactggcccaggcgacgagtgaccgagaggtgttggatttacatttggcgcaagggccggtctcggtgcgcacatttagttgggcgcgccagcttactgacaatgagatggcggcattactggcggcgaccgatactgtcgtcgccggggacattgcgctatcacattctcacgcacagcaagcgcaacagaccctcttacatgtactcgccctctatcaccaacagcatggcgatcagttggggttagggcgggcgcgtttgcgacgtatggctttaccgacgctggacgaaggggtggtattccgtctgattgataacttgctggcggagggagcgttacacaacacccgtgggtggttacatctgccagaacatggtttagcgtttactgagcaagagcagatagggtggcaacaagcggcaccttactttgttgatgacccttggtgggtgcgtgacttagcggccgagttgcaagctgcagagggtgaaatgcgcagcctattacgcaaagcggcgcaactgggttatatcactgcggttgtgacggatcgttattatctgagccaacgcattgagcagcttgctgatttggtccgtgagttagatagcagccaggggagtgtcagtgccgcagatttccgtgatcgactcggtattggtcgcaaactggcgatccaaattcttgaattctttgaccgcagtggtttcacccgccgccggggtaatggccatatattgcgagatagcggcctgttttctgcgacaggttcttgaggagagctatattgttgccagattagcgtttttgtataaattgaaccctactttggcagcaaaagtataaatatttgaaggattgattatcgcacttttatccactcgccagaaaacggcatctccggcgtccgccagacggggagaaaacgggtatcccaacagccagaacagaccgaatatcaaatcgctggcacctgctgtatcagtcataatctcctgtggattcaaccccgtttgctgttcgagtaaaccctccagaataaaaattgagtccctcaaggtgcccggtacaacaatgccgtgaaaaccagaaaactgatcggaaataaagttgtaccaggtaattccccggttggagccaaagtattttcgattgggtccggcgttaatcgtttttactggcgtaacaaaacgcataccgtcagcagaagcaacttctccaccaccccattgctgtgccaggctcaaggtagcctgataatcaaccaggggtcatgcggttccggcgtacaaccccagtacaaaaaatcaccttaacgtaccatattttccgtttcccaaacggagcccaagtataaatagaatgtgggttgtcttcgggtaaagccgaaagtgtgataaaacgaatatattgacattttggcgctccgggtaataaagaaaaagtagaacagggtgtatcaggataaatattgattagacgtcagtctattatcacgatagaatattacaatgcagtaataaggagataacgcagtgacagaattagaaatggaaaaaaaattgctaaataacggctttactgccaagaatattgcgcatatgaggaaaataatttcgcgtgatgacaagcaaaaagagacctattctagtttactcatagatttaaagaagcgttttttcgcgggatgtttgatttgtgctattttatttacccctcttatttttatgatgttcaatgattatacatcggatgaaatattcagttatcttgtcgccctgatttttggcttgtatatgacttattatataacgccactgaacttagcatggaagtcatatagatatctttccaataaggaggaatgatcctccttgctgtctattttctttcatactctgaattatcatccagataggtgctaccgataactcttattttatttgtagccttaacaccttgtatggtaagtgctagcttactcatgctgtttatttttcggtagtaatcggatggaatatatttatacaatctccacgcatcgggttttaatgacaatttaatgacaccatagaatgacgtagttaaatctgccgcataataggccaacataccggtttttctttcaaatccaaagaattcagccgttcccatataagcatcctgcataaaaccggtagcatttttattgcctcttaaccgctgaaccccttctgatagactacttgcaccatttaatatcaaatgagcaccaacgatgataccgacaatatttcctgaagctattgagccaaggagaattccacttccggcgaccatctgtaaaccgccaacaattacagctattccatcaataacatagccgataactttatcatgctcttcaattttagcggatatgtataccttcgcctgttttaatgaaagcatactgtcttgcttggaaaggtgatagcattccattttcaagttgtctatcccttccttgcaatcgttgtctgttctggcgttccgtataaaggtaaggtttttttgtgtaaattatttgatatcattctcaaatttcactctcaagaaaacatcttttatattattaaacgaaactcttcttgagagattgattaatttatcagcctctatttttgccattgcataaaaatatttattatttctttcctgcaagctcaaaccaatatccatttgctcactcctttttttatggggcaatctaacaaggtattatatctatagatagaacctattcctctatacattatataaaattacgattattgccctattaaaatggagtattttcagatgtttcttgatacatttagctttttgcgggtagagccaagacaaatgggtaatggcagagtagggaggcgggccaaccagccagtactggtaaatcagccattttgtcaccttgcagggcaagcccgcgaccgtaacagtctgttcgataaccgcccagcgttatttctgaccggaaattttaacgaatatatagacgcttagcgtaggttttcgccccattggacctcaaacccctttatctgggggaaatacgtatcggtgtgtttttaataccgtcttgagaaatatagcgtgggtaaaactatcctgctggagaagctacctgacgctcctccagcagggaataaacttactcggtagcaaccgcctcgggttggcggcggatgaacaccatcaccaagcctagccacagtaaaccgctcatcaggttaaacagattaaaccctctactgtcgccccacaggtaagccactttggccaactcaatacctaaggtgaagatcatcatgctgatcatccccatggccgcagagacggttcctttactgatatcactggcgaatagtgtcaaccgcaccagaccggcgttcgccagaccgataccaaaagcatacaggctcaacccggcggtcatccacagataggcatgggatgaatagagtgttgaaccggcggcgatcatcaggccaacaatcattgggccagcgccgtaacggatgagttgaggaatgctggttttaccgctcaatcgtgccagtgtcaggttacctataatcagtgcgccgaaaattggtacctgcaaaatgccatattcaaaagtagagagttgctctccgctgatcaaaattaccggtgactgggcaatccatgccagcaaaggcaggctggcaaagcccaatgctaaagaaccacagaggaagcggcggttagcaagtacttgcttataatcacgccacatgttggcaactgacagtttctcccctttcagcgaagcagtttctggcatcgcgcgccacaggccggcaaatgaaattgcccccagcactgcaaacaagacgaacatggtttgccaaggagccacatggatcagggcagcaccggccaatgggccaagcaacggagcaatcaatgccacattggccattaacgcggtgattttaatacagaccgcttcttcaaaagattcctgaatagtggcgtaaccgacggcaccgataaagcacaagccaatgccttgcaagaagcgcattgcgatgaactgttcaatgctattaaccagtaaaatggcaaggcaagtcacgacaaagaaagcgaccccagccaacatcactggacgacgcccacggcggtcagacaacggccctagaagccattgtaggaacatcccccccgccagataagcggtcatagaggttggaacccactcgacactggcattaaactcggcgaccactgccagcatacctggctggatcatatcgttggcgatatacgctgcaaattcgaacaatactaagcagagagggaataaaagcgcccgtcgacctaagcgtgtcgcgggtgaaaatgaagtttgcataaattaagctaattaataataagtatgtaaaagggaactgcttgggcagggcctacagtcggaacatgtcagagcggttattttgccgtcaatagcgtgttatggcaataattacccttagtttagtgatttgtggctgttgacgttcaaagcacatttgagccaccgagtgatgccagactgtctactccccgttatctgagacagacctgattagactttgaatccgtttttgattttgaatgggttgttgacgtccaaagcacatttgagcagccgagtgatgccagaccatcatctttaggcttttaattcgtttttgattttgaattggctgttgatgtccaaagcacatttgagcagccgagtgaagaatgaaggtaggacgcgaggcatggatgccgagcgagggccgcttgagcaggaagcgaatcggcccggtccgtcagcgaaatgatgaatcgagggaccccacgcagtgggcaagcgatagtgcgaaagcgcggggttccaagggggccacgctttgcactgaaccccaaaacttggacatctgctttactgcttttctacctgagtccggtattctgccggactcattccgcctgttttcaggctaatgcgctctgtattgtaataatggatatattctacaatgtcacgctttaaaactgtggctgaatcgtacttcttacggtgatacatctcggctttcaggtgactgaagaaattttccatcactgcattatctaaacaattgcctttgcgtgacatactttgccttatccccgcctcgacaagcattgagcgccacatcggcgttcggtaatgccagccctgatcgctgtgcaacatcaggccttcttttctccctttcactttcagcgctttttccagcgtcttgcacgtcaggattaatgctgctctttctgacatatgccaagaaataatctcattattaaacaggtcttgtatcaccgacaaatacagcttctgtgctccaactcggaactctgtgacatctgtacaccacttcaatccactgatttcggatgtaaaattacgagccaatagattatcggatgcccggccaccatcggccctataggagcgatattttttccgccgaatgaggctgagtaacccgtgctgattcatcagttttcgcaccgttttgtgattcagtgtgaacccttcttttctcagtgcgaccgtcatccggcgataaccgtagcgctgtgcgtgtcgtctgcttagggcgccaatcgcttttaccgcatctgcatagtcatcaattacaccgtccggtttcgatgcatgataatagtatgtactgcgtgccaattttgcggcacacagtaggcaagaaagtcgatgttctgctgtcagtgcttgaactattctggttttttctgctgctccctgagtgccttttcttctctcagggctttccgcttttttagataagcgttttccgcgcgcagatactcaagttctttctctagctccgcatgcgtcatctcgctgaacggttttgaatcgtgctcatatttatcttttggcatagtaggacccgttttcgatgggttaagcgcttcttttcctccctctcgataacgtttcatccagttttggataatcgtctcgttgggaatgttaaaatgagcagaagcatcggcagcgctacatctgtttgccatcatatagcggacaacgcaaagcctgaattctggagtataagttctggaaagatggtgctccagtccagcctcaccttgacggcgaaaagctcggatccaacgcgtaagaggggatttgccaacactgaattgacgtgcggtttcccgcagagtggcctttcctgaaaggtaatgttgaaccgccgctaggcgggttgaaaaagggtgtttcattgaaccgaacctccagatcatggataaaaagatccaagatctggggttcagtgcaaagcgtggcccccttggaaccccgcgctttcgcactatcgcttgcccactgcgtggggtccctcgattcatcatttcgctgacggaccgggccgattcgcttcctgctcaagcggccctcgctcggcatccatgcctcgcgtcctaccttcattcttcactcggctgctcaaatgtgcttttgacatcaacagcccattcaaaatcaaaaagttattaaaagtctaatcaggtctgtctcagataacggggagtagacagtctggcttcactcggctgctcaaatgtgcttttgacatcaacaacccattcaaaatcaaaaatagattaaaagcctaaggatgatggtctcgcgtcaatcggctgctcaaatgtgcttttgacatcaacaacccattcaaaatcaaaaatggattaaaagcctaaatatgatggtctggctagccctcctgctcggtcgagacgactgtgattaggtgatcactgaacgaatatcaaccgaacccgatcaccgactcaaatcacccaatcaaaaatataaataaaaaatacaaataatcagccaatatacttctcaatcgcagtcgccacaccatcctcgcagttggtccccgtcacatactgcgctatctccttcagctcagggatcgcattccccatggcaacccccactccggcgtagttaaccattgcgatgtcattcccctgatcacccaacgccatgacatttttctgcgcaatgcctaaatgctcagccagcattttcacgccagtacctttatccacccgcttactcaggatttccagataaaatggcgcactcttcataatagtaaaacgctcaaatacttcggcaggcatcatagccaatgcacgatccaaccgctctggctcatcaatcatcatcactttagggaaacgtaatgttggatccatctcctctactgcccggtacttcagagggatccccgtcaacatcacttcatgaagcgtatatttactgatgtccttattggcggtatataatgtattgaaatcaaaggcctggaaactaacccccaactcacgggataacgcttcaaaatagagataatcctcaaaactgagagtctcttgtaaaatacactcgccagtcgccgccttttgtactaatgcaccgttgttactgatgcaataatcgccactgttctccatattcagttcacgtaaataacgttgaaccccaatataaggccgaccagtggccagcaccacacagacgcctttagccctggcagcagcaatcgcctgctttacccgtggcgtaatttcatgctgtggattcagcaacgtgccatccatatcaatagcgatcagttcaatagccatagggccctcatctatatttaacgaatatctcatgctaacgcgattcagcacacgaatgccagtaagtctaagcacaggcaaatagcatcagaatgagaaatctaaaagcgatactcatcaggtaacaataacaattttcaggcaaaaaaaagcccagtggcagttttcccaccctggacttttttatctggccaataggctatctggctaacacattagatatcaatattggctgcgcgcagtgcattctcttcgataaaggcacgacgaggttcaacagcatcacccatcagagtagtgaagagttgatcggcggcgatggcatctttcaccatgactcgcagcatacgacggctctctggatccatcgtggtttcccacaactgatcggggttcatttcacccaagcctttgtaacgctggattgccaaaccacggcgggactctttcactaaccagtccagcgcctcttcgaagcttgaaaccggcacacgacgctcgccacgttcaacgaaagcaccgtcttcgattaagccacgcagtttgtcacccaatagacagattttacggtactcgccaccatggatgaaatcgaagtccagatcataatcggtatcaaccccgtgggtacgaatacgcaaaataggctcgaacagttgacgctcacggttctcacgcaccactgaactgtagctgctgccatggtgttctttttcgttcagcaagaccaccagcgaatcaatccattgcgtcacaacctctttattgcccaaatcctcttcttgcaaggtaggctgataaatcaggttattcagcaaagcacgcggataacggcgttccatgcgggcgatagtcttctggacactgtaatgctcagcaaccagtttctccaaaggctcaccagccagtgctggtgcgtgagcattggtatgcaatgccgcgccatccagagccagtgtcatttggtactgctccatcgcatcatcatctttgatgtactgctcttgcttacctttcttcactttatacagcggaggctgagcgataaacacatgaccacgctcaataatttccggcatctgacggtagaagaaggtcaacaacaacgtacggatgtgcgagccatccacgtcggcatcggtcatgataatgatattgtgataacgcaatttatccgggttatattcatcccggccaataccacaacctaacgcggtgatcagtgtcgccacttcctgtgaagagagcattttgtcaaaacgcgctttctcaacgttcaggattttacctttcagcggcaaaatggcctgatttttacggttacggccttgtttagccgagccgcccgcagagtccccttccactaagtagagttcggacaatgccgggtcacgttcctgacagtctgccagtttgccgggtaaacccgccagatcgagcgcacctttacggcgtgtcatttcacgggctttacgcgcagcttcacgggcgcgggccgcatcaatgattttacccacaacgattttggcgtcagttgggttttccaacaaatactcaaccaacttctcgttcatcagcgtttcgaccgccgttttcacctcagaagaaaccaatttatctttggtctgtgaggagaatttaggatcgggcactttcactgagacaacagcaatcaagccttcacgggcgtcatcaccggtggcgctgatcttcgcttttttgctgtagccttctttatccatatagctgttcagggtacgggtcatcgccgtacggaaaccaactaaatgggtaccaccatcacgctgtggaatgttattggtgaagcagtaaatattttcctggaaaccatcgttccactgtagcgccacttccaccccgatatcgtctttcatggtggagaagtagaacactttcgggtggatcgggttcttgtttttgttcagatattcaacaaacgccttgataccaccttcataatggaagtggtcttctttatcgttacgtttgtctttcagtttgattgaaacacccgagttcaggaaagagagttcgcgcaggcgtttagccaggatctcatactggaattcggtgttattggtaaaggtctggaaacttggccagaaacgcacagtggtcccggtttgctcagtttcacccaccactttcagcggtgcctgtggcacgcccattttgtaggtttgctcgtgaactttaccttcacggcgaataaccagttccaacttttcagacagggcgttaacaacggatacccctacgccatgcaaaccgccggaaactttataggagttatcgtcaaatttaccgccagcatgcaacacggtcatgatgacctctgctgcagataccccttcctcatcgtgcataccggttgggataccacggccatcatcctgtacagaaacggagttatccgcgtggatggttaccagaatttctttacaatgacccgcgagggcttcgtcaatagcgttgtccacaacctcgaataccatgtggtgcagaccggtaccatcatcagtatctccgatatacatgcccggacgcttacgcacggcatccagcccttttaataccttgatacttgaggagtcataagtattcgacatcaacgtttctcgctcatttttaatcctgtggttgaacctctattttgccatgttccacacggaacatcttgcccttttcacctaccatatcggcaacttgctcagcgctcacggcgctgacaaaaacttgtgcctgggtagctttcaaacgctcggccagcaatcgacggcggccggtgtccaattcggaagcaaaatcgtcaagcagatacaggcaacgccgcccgctctgtcgggtgagaaactcaccctgcgctaaccgcagtgcgcacatcagcaacttaagctgaccacgcgatagcaaatcttctaccggcgtaccatcggcccgaatgcggaaatccgctttatgtggcccaacggcggtatacgttagcgctctgtcacgctcaaactggcgcgccaacaactcgccatagtcactctctttatcccagccgcgctggaaagagaaactcagggcgaactctggcaggaacagagcgcatgtggctgaaatatccgccgcaatcgcgtcactgtatgccgctcgccattcactgatacgctcagccagagggatgatttcctgatcccaagcccggatttgcgtatagcgactaacctggcgcagcgcggcgttgcgctgcttgagtaacctttttaggttgctccaggccgtaaaaaaaccgggttcattatgaaagcaaccccagtctaaaaaagcgcgccggaattttggcccgccatttaataacgtaaaaccttcaggagtgattaactgcattggcaacatttgcgccaattcagccactttatgcccatcggtgccatcaatgcgcactttggtatcaccctgtcggcttttgctcagacccactgacgcctcacgttcattggcgtcaacccggccatgcaacacaaactcagcacattcgtgacgtatcactctgcctgcttgcaaactacgaaaagccctaccatgaccaagggtataaaccgcctcgagtacactggttttgccactgccattggggccgactaaaaaattaaagcccgccgccagcgccaagtctgccgattcgatattgcgaaaatctttaatgagtaaacgcgttagagccatgaaactaattcttatgatcgaaggcaatgtcgccttatttctgatcaagggcgttatcgtcgcaggccatttgcgtgcggccagcgcgcagccaccggagcgtacttcatgtacgagaggatggcgagcgctgcccaatcgcaaaggggcaagcaagatagcccgataaatactacaaacgcattggcatgacgacataggctgcagcttggctggcgctgtcttcaatctgcacactggatacagagtcagtcaataacaggcgcacatcttcgcacttcagtgcatttagcacatcaagcacatagctgacgttgaaaccgatctccatttctgtcccctcgtagctaacatcgaggatctcttctgcttcttcctgttcaggattattagcagtgattttgagttgattgtggctgacatagagccgaacaccacggaacttctcatttgacagaattgccgcacgcgaaaatgcctgtttcagtaaatcgcaaccggcttccagcattttatcaggattcttcggcaatacgcggcgataatccgggaaacggccatcaaccagcttagatgtgaaaataaaatcgcccacatgagcacgaatattattactgccaatttgcagccgcaagggggtatcaccaccatccagcaaccgaaccagctccatcacacctttacgcggcacgatcaccgaatgtgagggtaacgtctggccaataggcattgagcatacagccaagcgatgcccatcggtcgccacagtacgtaactcttcgccttcggtctcaaacagcatgccgttcaaataataacggacatcctgatgggccatcgaaaactgagtggactcaatcagacgctttaacgtagcctgcggtaaagtgaattcaacctcactctgccagtcatccagattagggaagtcaatcgcaggcaaggtagacagcgagaaacggctgcgaccagagcgcactagcaggcgatcaccatccaacgctaccgtaatttccgccccttcgggtaaaccacgccagatatcaaaaaacttccgtgcgggtactgtggtagcacccggctcatgggactgagacaaggcaacacaagccaccatctccatctccaagtcggtaccggtcagccgcaaagagccttccgtgacttgcagcaacaagttacccaaaataggcaacgtagggcgtccacccagcgggctactgacctgttgcagtggttttagcagatgctcacgttcaatgataaatttcatagcgctaggaggataatgttctgattaagttagagaaatcttctttgatgtcgtgactttcctcacgcaattgctcaatcttccggcaagcgtgcaacaccgtggtatggtcgcggccaccaaacgcatcgccgatttcaggcaggctgtggttggttagctcttttgccaatgccatcgccatttggcgagggcgggcaaccgaacgggaacgccgtttggagagcaggtcagcgaccttaattttataatattcagcaacagtcttttgaatattatcgatagtgaccagcttttcttgcaacgccaacaaatcacgcagggcttcgcgaacaaaatcaatcgtgatagcgcggccagtaaaattggcattggcgatcacacggttcaatgccccttccaattcacgcacattggaacgcagacgcttggcaataaagaacgcgacctctcctggtaagcgaatatcattttcatccgctttcttcattaggatcgctacacgcgtttccagctctggtggctcaatggcgaccgtcagcccccaaccaaaacgcgacttcagacgatcttccaccccgttgatctcttttggatagcgatctgaggtcaaaatgatctgctgattaccctctagcaacgcattaaaggtgtggaaaaactcttcttgagaacgctctttattggcaaaaaattgaatatcatcgattaataaagcatcaaccgaacgataatagcgtttaaactcttcgatagcattattttgcaaggctttgaccatatcttgcacaaaacgctcggaatgcatatagaccactttagcattggctttacgggccataatgccattccccaccgcgtgtagcagatgggttttacccaagcctgttccgccataaagaaataacgggttataggcaccacctgggttatcggctacctgacgggcggcagcgcgggccaactggttagatttaccttcaacaaagttatcaaatgtgtgttttggattcacattcgaacgataagaaagttcaggctgagcaggtgagttgtcccagctcgggcgcataggtgcactgcgagtaaccggagcaacaggcgcactcacgctggctgtaactggattattgtgtgctcttgccgcaggtttactccctacctcaaaacgcagtaaagggacctcggtgccacaaaaatcattaagtaagccattgatattgtttaagtacttatcacggacccagtccagtacaaaacgattaggtgcgtaaagcgccagagtattgtcactcagttccgcctgtagggggcgtatccacatactaaattctgtggcaggtaactcatcctgcaatcgggcaagacactgctgccaaagcgaaagtgacacggcggactccactcgaacaagatcaataaaagaaagaaatcaggatattttgtaactcatcgttttgacacacgccatatggcctgtagcaagccaaggtgacatgcgaactgttttttacagttgttttttactgctgattttttacgactcacattcccccacgatcccagagtagaggaagcgatcggaatggcggatcataacgcaaaaggagcaatagatcctctccttcctcacagattagatcctttttatccacaggctgttacttttgcgatgagtgtaacccagcacatcggttttcgtgacctcatcgttaaggatccataaatatttcggaatatactggtgtccccttcccctttctcaggcaatggatcccttttaatcggcaaaggatctcaccgcgatccttgcgctttggcggggagtccgtataatcctcagccctacgtgtgatgcctgtgttcttaatagcaatagcattagctaaagggaatccagcagtaaacacgggcaggcaggctcttggtaaactccccgtttagaaaacttctaagcggcagatgcgatgtcaattgactcgggactgtacaattattacaatcccgcttctttatatgttgcgattgaggcgtcggtagtcttcactccgagcagccaaacgcgtttactgaatcagtaattattttaagtttaggtagaaatcgctatgaaacgcactttccaaccgtccgtattgaagcgcaaccgtagccacggtttccgtgctcgtatggccacaaaaaatggtcgtcaagttctggctcgccgtcgtgcgaaaagccgttctcgtctgactgtttctaagtaataaaagctaaccatctcagtggttaagctcgcatttcctagggagttacgtttgttaactcccagtcatttcactttcgtcttccagcaaccacaacgggctggcacgccgcaaattaccatcctcggccgcctgaacgagctggggcatccccgcatcggtcttactgtcgccaaaaaacatgtcaaacgtgctcatgaacgtaatcggataaagcgcttaactcgcgaaagcttccgtttacatcagcatgcgttaccgtctatggattttgtcgttttggtaaaaaaaggtgtggctgacctcgataaccgtgcgttgacggaagctttggaaaaattatggcgtcgccactgtcgccaggctcccgcatcctgatcgggctgattaggggctatcagctcgtaatcagtccgttgctggggccgcgttgccgtttccatccgacgtgctctcattacggaattgaggcattgcgcaggtttggcatgataaaaggcagttggttaacactgaaacgcgtattaaaatgccaccctttgaactcaggtggtgatgaccccgtgccgccgaaactcgacgataacagagaacactaacgatggattcgcaacgcaatcttctactcatcgctctgctgttcgtgtctttcatgatctggcaagcttggcaagtggataacaatccacaaccaaccgctcagaccacgcaacagactacgaataccgctaccggtgataaagcaagccaggctgtgccaggcagcggtcagggtcaactgatcactgtaaaaactgatgtgctgtctctgactattaatacccgtggcggtgacattgagcaggctaacctgctggcttacccagatactttgggttcaagtaatacgttcgaattactggaaaccactccaagtttcgtttatcaggcacaaagtggtctgacaggcaaaaatggcccggataacccagcgaatggcgaccgtcctttgtttgaagtgccacaaaccagctttgttctggcagatggtcaggatgaactgcgcattccattgaccttcacaagtaaagatggctctgttttcattaagactttcgtgctgaaacgtaacgattacgccattggcgtggattatcacgttaacaacgcctccgctgccccactggagctgacgctgtttggtcaattgaaacaaagcatcaacttgcctaaaaagcgtgataccggtagcaataactttgcgctacagacttatcgtggtgcggcttactcttctgatgaaactaaatataagaaatatagctttagtgacatcgaagacaaaaatctggatatcaccaccaaaggtggttgggtcgctatgttgcagcagtatttcgccacagcatggatcccagcggctaacgaaaccaacaccttctactctgctgagttaggtaacggcctggccgcaattggtttcaaaggtgcgcctgttgttatccaacccggtgaacagaaacaactgagtgccacactgtgggtgggcccagagattcagaataaaatggcggaaattgcgccacatctggacctgactgttgattatggttggttgtggttcatttctcagccactgttcaaactactgaagtttatccacagctttgtggggaactggggcttctccatcatcgttattacctttatcgtgcgcggtatcatgtacccgctgacaaaagcgcaatacacctcgatggcgaaaatgcgtttgctgcagcctaaactggccgccatgcgtgagcgtatcggtgacgataagcagcgtatgagtcaggagatgatggcgctgtacaaagcggagaaggttaacccgctgggtggctgcttaccgctgatcattcagatgccaatcttcttggcgttgtactacatgttgatgagttctgttgagttgcgccatgcgccattcattctgtggattcatgacctgtcagcacaagacccgtactacattctgccaattctgatgggtatcaccatgtacttcattcagaagatgtcaccaaccaccgtgactgacccaatgcagcagaagatcatgacctttatgccggttatcttcacggtattcttcctgtggttcccggcaggtctggtgctgtactatatcgtcagcaacctggtgaccatcctgcaacaacagctgatttatcgtggtctggaaaaacgtggcttacacagccgcgagaagaaaaaataacccacagcgataatcatgagtatttagggcggtcaatatgaccgccttattctttttacagaagcctgattttttaccttcagatttgtgtaaaaataatacagacttgttacaaaaataatcgataaagagagaaatcaccatgagcaccactgatactatcgtggcccaagcaacgccccctggtcgtggcggtgtcggcattctacgtgtttcaggtcgtgctgcctcagaggttgcacacgccgttctgggtaaattacctaagccacgttatgccgattatctgccgtttaaagacgtggatggcagcacgctggatcaaggtatcgctctctatttccccggtccaaattctttcactggcgaagatgtattagagctgcaaggccatggtgggccggtgatactggatttactgttaaaacgcattctagccctgccagggctgcgtattgcccgccctggggagttttccgagcgtgccttcctcaacgacaagctggacttagcacaggctgaagccattgccgacctgatcgacgccagttcagagcaagcagcacgttcggcagtaaactcattgcaaggcgcattttcagcgcgtatccatcaattggtggaagcacttactcacctgagaatctacgttgaagctgccattgactttccagatgaggaaattgacttcctttctgatggcaaaatcgaaggccaactgaatggtgtcatggccgatctggaacaggtacgtactgaggctagacaaggcagcttactacgtgaagggatgaaagtggtgattgctggccggccaaacgcagggaaatccagtttactcaatgcgttagctggccgtgaagcggcgattgtaacggatatcgcgggcaccacccgtgatgttttacgggaacacattcatattgatgggatgcctttacatatcattgataccgcagggttgcgggaagccaatgacgaagttgagcgcattggcattgaacgcgcgtggaacgagatagaacaggctgatcgtgtattgtttatggtggatggcaccaccaccgatgccaccgaacctgcggctatctggccagagtttatggcacgcttaccggcaacactgcccatcactgtggtacgcaataaagcggatataacaggtgaaacgctggggctgaccaaagtgaatggtcactcacttattcgtctgtcggcacgcactggagaaggtattgacctgctgcgtgaccatttaaaacaaagtatgggctttaccagcaacactgaaggcggtttcctggctcgacgtcgccatttacaggcactggagactgccgccaggcatttggtacaaggccatgagcagttagtgagcgcttacgctggtgaattactggcagaagaactgcgtttagcacaacaatcattgagtgaaattaccggtgaatttagttctgatgacttactggggcggattttttccagtttctgtatcggaaaatgagtgtaataccataaagctagcaccagttatcgctaattttgataaccttactctatgggtttggcagtggctcgaacacttaacgttgtataccctaaataattcaagagataccctaaataattcaagttgtaggaaagcggctaacgcacatgcaacttgaagtatgacggggataattactcgtttcacaaattgaggttcccatgattataaaaccacgtgtacgcggctttatctgtgtgacagctcatccgacgggctgtgaagccaacgtcaagaagcagatcgactacgtcacaacagaaggcccaatcgctaatggtcctaaaagagtattagtgattggtgcgtcaactggatacgggttagcagcccggatcacagcagcatttggttgtggcgccgatacgctgggcgttttctttgaacgccccggtgaagaaggcaaacccggaacctccggttggtacaatagcgcggctttccacaaatttgcggcacagaaaggcttgtacgcaaaaagcatcaacggcgatgcgttctctgatgagatcaaacaactgactatcgatgctatcaagcaagatctgggtcaagttgatcaggttatctatagccttgcttcaccacgacgcacccatccgaaaacgggcgaagtgtttaactcggcactgaaacctatcggtaatgctgttaatttgcgtggtctggacaccgataaagaagttatcaaggaatcggtcttgcaaccggcaacacaaagcgagatcgacagtacagtggccgtcatgggtggcgaagactggcagatgtggattgacgctctgttggacgctggcgtactggccgaaggggcacaaacgacagcattcacctatctaggcgaaaaaattactcacgatatttactggaacggttccattggcgcagccaaaaaagatctggaccagaaggtgctggctatccgcgagagcctggcggctcacggcggtggcgatgctcgcgtatccgtattaaaagcggtcgtgacccaagccagctctgccattccaatgatgcctctgtatttatcattgctatttaaagtgatgaaagagaaaggcactcacgaaggctgcatcgagcaggtctattccctgtataaagacagcctgtgcggcgattcaccgcatatggaccaagaaggtcgtctgcgggctgattacaaagaattggatcctgaagtccaaaatcaggttcagcagttgtgggatcaggttactaacgacaacatttatcagctaactgatttcgttggttataaatcagagttcctaaatctgttcggtttcggtattgacggtgtggattatgatgcagacgttaaccctgatgtaaaaatccctaacttgattcagggttaagctccggtttattgctcaataacctgctgcgtcactatcacgcagcaggttgatcatcttcttactgggggttatcaaaaatatcaattgcaaaccgcagggggttttacgaaattatttggtgacatccatgatattctgtcgcaagcaacgtagttatcctgttttagtttgtaggtaacataaaaagaaatgggtaaactgaggattactgatatcacggatattattaacaaacatctgcaaataagtgaatcatatttgaaccgccaaccagaaacaaggtaaataaggccgcttaataaagcataaataagtagtggaattgataagaaagcgataaaaatagaagcagaaaatgttatttcctttgccataaccatatatgaattaatgtatttatagcttaggtattctattggaattattattaacaacaatattattgatgctaatatattaaagtatttattgttcattatttccccccagcccattaagaatatattgaaggtttgcttcaggggttctagggtgtatctccatttctttttttaataatgctataatttttacacttatcccatactttttatctaaaaaatctaaaccgatagtaatagcaccccctagaacaaaaaccgcaaacgcaacagcgataacactaccccccaagaaaccgacagcagttaaaactgatccaagtaaaaaggatgtggctgaagcaacggctatcttggccatatccatcgttatatttcctacaaagtcgactaaggtatgttcatttttaaaaatacattcagaaattctatatccgatagaaaaaaataatacaaaactttgctccacgaataatccctgaagctatgcctcttaggccaatacccatttctaatatttgagggttagtggttaggtatcgtgtacccgtaattatttttctaagtcctgcatagcctgaaatcttaacgaacttagttccgttatcaccaataaatattgtggcttttattcctattttcttaaactccataataacgttatataaccctctgacatcatgtatatttcctgcgtaagttgacgttggatctgtaactttaaatataggtgcgaaggggtcatttatatcaattcctcttgaaaacgcttccatagatgtaatttgttcaccaactcctctagcaaatgattctggtgtacttacacccatctttttttgggttctatttgttatgtcgtcaattatatcgtttgcttctgctgttgttagtacaacatgatattgtttctcattacgtaatattttttccaagcctatggaatcaaaaaattcatgctgaggtttcaattggtttatttttgtgttgccattcaggaagtcccccattgcacctgtccaacttggatcgtaaatttctcttgccataaaatatcccgatttattttttataaaactatgtgggttattctatatcatatatagggtccgcttggaattcggaaaaaattcggcacgattataaataactgagaccttaagctcgggtaaactgagttatcgatttttgtggcaggaaaatcgatgattctatttcactgttggcattttaatgggtgctattatcctttggattgtgcgttgatactgaaagcatagcatcagctattatgaacttcaggagatactggctgaatgcgatgtcaacatcgaccacaccacgatttatcgttaggttcaacgctatccccctttaaataaaagatagctcgttggtactggcgtcattcaacaggtatacgctcatagcgtattaatgaaatctatcttcaacaatgcctacttatctggttgatggcggtgaagcaattattatcctaaacgaatgcttttattaatcgagttcccccaatcctaatacaccgagagggggagttttttacttaatattcaaacgagttaatcgccattatcagtgatcaacaaacgcaattttcagcataaacagtagcgccactaccactacgcaagggctgatttcacgccagcggccagtacctaatttcatcaaacaataagagataaagcccagtgcgatcccttcagtgatagagaaactgaacggcatcatgacagccgtgacaaaggctggaacggcttcagtcaaatcatcccacttcacccgtgccaggctagatgtcatcaacacgccaacataaatcagcgcgcccgcggccgcatacgcaggaaccatacccgccaacggagaaataaatatcaccagcaggaagagtatcccgacaacaacagcggttaacccggtacggccgccaacagataccccggaagaactttcgatatacgcggtcactgatgaagtaccaataaaagcaccggcaacggagctgatactgtccacatacagcgcttgtttcatgcgcggaaacttgcctttatgatccgctaaaccggctttatccgtgacaccaatcaatgtgccggatgaatcaaacaggttaaccagcatgaaggagaaaataatacccgccataccaatattcaacgcgccagctaaatcaacctgcccaaccacagaagtcacacttggtggcatggagaaaacgcccgaataatgcacatcacccagcgcccagccaatcagtgtggtaaccacaatagaaaccagcactgccgcgtgaatattacgagaagccaagactgcgataataaagaaacccagtgcacccaacagtacactgtgagaggtcagattacccaccgccaccagtgtatctgggtttgcgaccacgataccggcattcttcaaccccatcatggcaataaacaggccaataccacttgtgatccccacacgcaggctcagtgggatgttcgctatcatccagtaacgaatgcggaaaatggttagcaaaaggaaaccgattgccccccagaaaatagcgcccataccgacctgccaagaaatacccatcgcccccaccaccacaaaagcgaagaaagcgttgagccccatcgccggtgccagtgccacaggtaagttagccaataagcccataaaaatgctgccaaatgcggcgatcaggcaggttgtcacgaacaccgcctgcacatccatacccgcaaccccgagaatctgcgggtttacgaatacgatatagaccatggtcaagaaagtcgtgatacccgcaatcagctcagtacgagctgtggtgccatgctgtttcagtttaaatacacgttcgagcaggccctgctcggtatcaaggtttgatttactcattcgaagagttccgctgaagggagtgatagtcggggcatatcctataacaaaaaccatttgtttagagcgtgatcacactcttttttacctcttttttattatggcttttataaacgtctcttttcgcgccaaacgcgccagcccgatgaccggattaacctctgtggttaagacaattcagcaccgttcatcactcggcaatttcaagttaagaagaagatatcagactgctgacaaaccccgatgacgcgatcttgaacggtgaggataggcagaggagtaaagcgtccgcgccaaggatggcgcggctcgagcctacatggatgtatttacggcgtctttacgatctgcctgttctctccgtcgcgggcactttgtcaataacctcaagatattaattttattactaacaggctaataaacatcgctttatttattaggatggttagagtgggattaactgatgtctatcttttttaaaggattagttgcgtgaatcagattcaatgcgtcatgttcgattgcgatggcaccttggtcgacagcgaagtcctgtgttgccaggcttacgtcctaatgtttgctcactacaatattcacctgtcgttagaagaggtgattaaacgctttaaaggcgtaaaactgtatgaaattgttgggatagtctgtaaagaatatggattagaccaaccgataaaggtactggaaaagctttaccgtgaagaagtagcacgtttattcgatgccgaattacagcctatagccggtgtgaaagcgctgttagagcaaatcgtgttacccgtctgcgtggtatccaacgggccagtcagcaaaatgcagcactcgcttggcctaaccggattactgccattctttgaggaccggctttatagcagctatgatattcagcgttggaagcctgatccggctctgatttaccatgccgctgaacatatgcaggttgccgctgagcactgtattttgattgaagattctgccgcaggtgcccaggccgggattgccgccggtattccggtgttttattactgtgccgatccgcacaaccaaccgattaaccacccgctagtgactactttcacggatattcagcaactgcctgatttgtggaaggaaagaggctggcatatcacccgcgattaatttacctgtaatgaattagcctgcctgtaatcaattaactcgattgcagtgttagcttgttacaccaccagcgccatgaacgtgccatggcgctttgttttttaatggcatgctgtgggctaaagcggcgattaaggccgttagccagtagatccagcgccagacataaaacaaaatagaccaatgccacaaacagaaagacttccatcgggtaaaccatactgcggttattaacctgtgtagccaaaaaggtcagctcattcactccgacgatataagccagcgatgtatctttaatcaatgatatccattgattaataaaggacggcaccatcatgcgcagcgcttgtggcaatacaataaaccacagggtctgccagcgattaaaacctaacgacagccccgcttgccactgcccggcaccaatagccattatcccggcctttaccgcatgagccagataagcagaagcaatcagcgccagtgcacacaccacagtggtgatttcaggtatatccacaccaaaaacgatcggtagcaggaaatacgtccaaaaaatcaacataatcaccggaatcgcacggaagaagcccaaaacagcggccaatattcccgcccagacaccacgggacatcgccaatgccacgcccaacacagtgcctaatacggctgaggttaccccagccatgatactgatcaccacggtcaatgccgcccctcccagagggccatcagggaaagtcccccacagcagataacgccagttatcaacgataatggtaaaatccatctcagtgccctcggacgacggttcgctgttgacgccacataccccaagcctcaattagcgcgatgatgaaaatatacaatagggttgcaaccccgaatgcctgaaacgtccgtaatgtttcagtttcaacctgccgggaagcataggagagttcagctacaccaatagccattgccaatgaagagtttttaataatattcatatattggcccagcaacggaggcatggctattttcaaagcctgcggcaaaaccacataccgcatcgattgccaccccgtcagccccagcgcatgtgcagcatatttctgccccttggctacgccgctgatgcccgcacgcagctcttcagcaataaatgcggtggaatagagtgtcaacccgacaaaaccggctaaaaactcaaaagagggccaggccagagttaatccggcaagcgtaatttcatggggagtattgagccaagggatccaagaagctggcaggaattggctggcagcaaagtaccaaaagaataattggatcagcagaggagtatttcggaataaggcactgtagccaatagcaaagcctttcaaggcctttaactcactgtctctggccgcggccagcaaaaatcccaataacgtggcagccaccaccgtacaggcggaaatccacaacgtcagtaaaaaaccatcccacagccaaccaagatattgcggggctaatagccaatcagtcagatgatgtagattcataggcttttatatctatatccatctgatgctctaatcgcatgagtttttaagtacacaataaaatccatcttatttttacttcataacttaacataccgacgtattaccgtactgatagccaaagtcattggcattgcaggtaggcaatcaacccctgcaacgccaaaaacgaaggggataagttacgctttaggctgttggtctaacggggcaaatttaaactcaccacgcggttgtgctgaattggtttccggcccaaaccagcgatcataaattttcacggcgtcaccctctttctccagcttaattagtgtctcgttaaccacggctgttaagcgatcttcgcctttaggaataccaacgccctgatactctttggtgatactaaaaggtgaaatctcaaaatctgctttttgcgcttcagggatattacccagcaggcccactaattttgcatcatcctgcgtgatagcttgaacgttaccattacgtagggcggtgaatgccagcggtgtatcatcgtaagagatcactttcgcggttggataatgctcacgtaaagtaatttcctgtaccgtgcctttgtctgcaccaatacgtaacttaccaatatcttccggtgtttttaatacgcctttgcgagcaataaatttttgacccgtcgcaaaatagggcaggctgaagttcacctctttggcgcgttcatcagtaatagtgaaattggcagcaatcaaatccacttttttagaagccagtaatgggatgcggttcgccgggttggtcgcccgtaactccactttcacccctaaatccttagcaatagcattagccacatcaacatcgtatcccaccagctttttagtctgcgggtcgatataaccaaatggggggttgctatcgaaaacagcaatccttaccacacccgcttgcttgatatcatccaacttatcagcgtaagcagtgccggaaagtgtagctagacccgcgagtagcgttaaggctattgcacttttttttatggaaagatcctgtttcatgggaaaactcctaaagagatgagatattgcgttatgtatacgctaccaactccgtgttaggtcaggaaataatataaaacgatatgtttataaccaattaatctcaatgagttaatctggctgcattgggaaagtgagacaaggccgtagagcgacaataaagcagtaacttaggcggttcactcttgtttaaggaacatatatttctgaattttcatatcaagaaacgttactgctgtgctggccggcagcgacgtcctctgctttagctttatcctgacttatggcgataactggcttggctttactcttgacttggctaaccggttcttccgtaatttccgactgaccaacaaaaataccgccctttttgattgagaaattactgcccttcacgataccttttaagcgaccatgttccagaatttccagatcatcagaaatacaaaccccttcaaccctgccatcaaccgtaatatggggggcagttaaatttccctcaatctgcccactacgcattaatctgattgaaccttcattgacgatgatatcccccatcaccacaccataaatctgaatatcaccatccagattaatattgcctttcaactgtgtacctgcggcaataatagtattgtttttagcattttcctgtgaagcattagataatggcatactcgtttggctagggatatttacgctagaagaaccgtcattattactatttactttctttttgaacataacattactcactgtaaagatgaggaataatgcaggaacgataaaaagatagaaaaacaaatcgtagatagcataggccactaaagccgcaacccacaggccccacaagagactaagcaccatgttcttgcgtatgtaaaagctcattactttctatcccgccctgcttgaaaaaacattaatcattattttcaataaataacacagtctctgaaaaatattccggaattatattttcctatatgaggaaagtgtatttcccattaataaaaataaataactaaaataaaaaataaccatcgcattatgtgcgatatttgtcaaataggagtataaacagagagtaaatatataataattaatagcgggggaattatggttattaataacaaggagtggataaaaaaaccggtcaaacgagtaggctgaccggggttaaatattatttttcaggcttaccagagagtaacttctctaagtcatcaccaccaaggtggcggaagtcatgccctttaacaaagtagaagataaactcgcaaatattctgacagcggtcaccaatacgttcaatggaacgagcacaaaacaatgcagttaacacacttgggatagttcgcggatcttccatcatatatgtcatcaattgacgtacaatgccttcatattcttgatcgacctttctgtcttcacgataaatccggatagcttcatccagatccatccgagcgaatgcatccaagacatcatgtagcatttgcaccgtatgacgccccaaagactctaggctgaccaatagcggttgatgttgatgagagaatttttccaatgctgtgcggcagattttatctgccacatcaccaatacgctctaattcggaaatggtcttaatgatagccatgactaaccgtagatcactggctgttggctgacgtttggcaatgatgcgcacacaggcttcatcaatggccacttccatcatattgaccttttcatccccatcaattacccgctttgccagctcgccatcttgattatgcatggcggtgatcgcatcagataattgttgttccaccaacccccccatagttaaaacttgggtgcggatatgttcaagttctgcattgaactggccggaaatatgtttatttagattcagattatccatgatacttcccgtacgtatggcctatcccaaaggcagtaggcgtaatgaatgtagttgcctatgtgcagtagcccagtaataaggccatcaaccatagcgaccagtgatataatcttctgtctgtttttgctgtggcgtcgtaaacagggtatctgtatcactgaattcaataagctcgcccagatacataaatgccgtgtgatctgaacagcgagcagcttgctgcatattgtgcgttacaatcacaaccgtatagtccgatttcaattcactaatcagctcttcaatacggccggtagagatcgggtcaagcgccgagcaaggctcatccaacagtaatacatcagggcgaatggcgataccacgagcaatacacagacgctgctgttgcccgcccgataagctataaccgctctggtgcaacttatctttggtctcattccataacgctgctttggtcaatgcccattgcacccgctcatccatatcggcgcgagataagctctcaaacagtttgacaccaaaagcgatgttgtcgtaaatcgacatcgggaacggagtcggcttttggaaaaccataccgacttttgcccgtagcaaagcaatatcttgtttatcggttaggatattttggccatctaataagatgtcaccttccgcccgctgttctggatacagctggtacattttattgaaagtacgcagtaaagtagatttaccgcaacctgacgggccgatgaacgcagtgacctgattcttggcaatatccaacgaaatattcttcagtgcatggaatttgccatagtagaagttcaaatcgcgaacctgaattttactgttggtgacgtcagtagccatactcatcaagacttctctcttttagccaataccgccgaagcggcattttggaatttattggcgaataggtattttttcttagctaattagtgctttttcttagcaaaaataacccgggccagaatattcagtaacaggacacacaaggtgatcaataacacccctgcccaagccagattctgccattcagcaaacgggctcatagcaaacttaaatatagtgaccggtaagttagcaataggccgtgtcagatcggtactccagaactggttggagagcgaggtaaacagcaaaggtgccgtttcaccagcaatacgtgcaatcgccagcaaaataccggtcaaaataccagaaacagaggctttcaacgtgatagccgagatcatccgccattttggggtccccaacgcataagccgcttcccgtaggctatcaggtactaatttcagcatgttctctgtggtgcggataacaatcggcacttgtaacagcgccagtgcaatcaccccggcccaaccagagaagtgctccatcttggcgaccacaatggtgtaaacaaacaggccaacaacgatagacggtgccgataataagatgtcattaataaagcgggtaacttctgccaaccacgatttacggccatattccgccagataaatcccagccatgatcccaagcggggtaccgataactgttgcccacagaattaataacccactaccagcgatagcattcgctaagcccccgcccgcagtatttggtggtggtgtcatctcggtaaacaatgccagagacatcccatcgatacctttggtgacggtggagaataaaatccatatcaaccagaacaaaccaaatagcatcgttgccattgaaagcaccaaggcaatccggttcttttggcgacgccaagcctgctttttacggcggctctccatcagcgtcgcatcatttcgcatatctatggtcaccatgttaacgcccctcgttcttagccagacgcataatcattaacttagatagagccagcacgataaaggtaataacgaacaaaataagtcccaactccattaacgcggcggtatgtaagccagattctgcttctgcaaattcattcgctaacgcagaggtaatactgttaccaggcataaacagtgagaaactatcgagctggtaggtgttaccgataataaatgtcaccgccatggtttcacccaatgcacggccaagacctaacatcacaccgccgataaccccattcttggtgtaaggcagcacaatgcgccagataacttcccaagtggtacagccaatgccataagctgactctttcatcatcacgggcgtttgttcaaagacatcgcgcataactgccgcaatgtaaggaataatcatgatggctaaaataatacccgcagccaaaataccgataccgaatgcagggccggagaacaaagtcccaacaattggaataccggacatcacgttgccaacaggctcttgaaaatagcgggcaaataatggagcaaagacaaacaggccccacataccgtaaacaatacttgggatcgccgctaacaactcaatcgcgacgcccaaaggccgttttaaccaatttggcgccagttccgttaagaacaaagcaataccaaaactgacaggcacggcaataatcagggcaataaccgaggtgactattgtgccgtaaatcggtactaatgccccgaactgctcagccggtggatcccactctttggtccagagaaaagcaaaaccaaacttttctatactcggccaggaagcaacaatcaatgaaatgataatgccgcccaacagaaatagcgtaatcagcgcagccagttttactagcgcactgaaaatgatgtcaccgtatttactcggtgctttgatcgtcggcttgtacgcagccatagactctcttctcatcagggtgttttccccttcgtacttgacgccgcaggtgtgttagctctgttcacacccccgaatcacttactggccttgaccctaaaacttactggtcttggccttaaataagtcagctcatcgggatgcgttcacttgctgcctacctgcagctccaattactttgggtattatattgaatcaatattttataaatcacttgttgccagtaaatcagaagattggcttgccgctgctatctttaatctgagttttccaagctgcacgtacttgttcaacaacttccgcgggtaatgttgcataatccagttcgttagcttgtttagcgccgtgtgtgtaaccccagtcaaagaatttcaatacttctgtgccattagcagcattcttctgttctttatgcactaagatgaaggtcgttgaggtaattggccaaacatcatcacctttttgattggttaagtcttgagcaaatgacttgctccagtccacaccttttgctgcagagctaaagctgtgctccgttgggctaacgggcttcccatctgctgaaatcagttttgtgtaagccaaattattttgtttcgcgtaagcatattctacatagccaattgagccaggcaggcgctgaacaaaagcagcgataccgtcgttacctttaccacctaaaccggttggccagttcacggtagagccagccccgactttctctttccattctgcgttcactttagccaagtagctggtgaaaacaaatgaggtacccgagccgtcagcacgacgtacaacagcaatattttgatccggtaatttaacgcctgggttcaacttaacaatcgcaggatcattccactttttcacagtgcccagatagatatcacccagcgttttaccgtctaatgtcagctcaccggatttaatgccaggaatattcacggctaacaccacaccgccaatcacggtcgggaattggaacaaaccttcagtagccagtttttcatctgttaatggcgcatcagaagcaccaaaatcaacagtattggcaataatttgcttcacgccaccggaagaaccgataccttgatagttaattttgttacctgtttctttctgataagaatctgcccacttggcatacaccggtgcggggaatgtcgcacctgcacctgtcaggcttgcagcagcgaacgcggatacagcagtcatagataaagtcgctgccacaatgctggctacggtggtacgcatcagtttcataatccctcctaatgggatattagaattaactctttacccaacgaacttggtgttgctagtgggtagcgaatgaatcccaagaaacttactcaggtaagtggtttggggggaacatcgctaacaaccctgcgacttcaagtacgaagtgtataaattgttttcatcagatcaagtatggtgcaggagggaaaataggacagtttaatgacagaaaaatgtacggattattacagttatatgacaagccatttgctatcaaatgaacttatttattatcaacgcattacgttattatacagtggttttttattcttttatttgtaaaaaattcagcgtatcagttctctttccccctaaaaaaacgattagtatttaagctaaactaataactgattatttaaaaataaagacaaaaaagccgacaaatttgccggctttcgttaatacgctattctttcgttaataccctatcttagagcaacttattcaaccgttactgattttgccaagttacgtggctgatccacatcagtgcctttaatcagcgcgacatgataagacagtagctgtagcggtacggtatagaagataggcgcaataatttcttcgacatgtggcagctgaattattttcataccttcgctatcagtgaacccggcatcttgatcagcaaacacgtatagcaaaccaccacgagcacgcacttcttcaatattggatttgagtttttccaataattcattgttcggtgccaccacaatgaccggcatatccgcatcaatcaatgccaatgggccatgcttcaattcacccgcagcgtaagcctctgcgtgaatataagagatctccttcagcttcagcgccccttccattgcgatcgggtattgatcaccacggccaaggaacagtgcatgatgcttatcagagaaaccttcagccaacgcttcaatggttttatccagagataacatctgctcaatacgtgcaggcaatgcctgtaacgcatggacaatatcgtgctccaggctggcatcagcacctttcagcttacctatacgccccaccagcatcagcaaaacagtcaattgagtggtaaaggcttttgttgaagcaacaccaatctcagtacctgctttggtcatcagcgctaaatctgattcgcgaactaaagaagatcctgcaacgttacaaatggccagtgaacctaaataccccaactctttagataaacgcagagctgccagagtatcagccgtttcgccagattgtgacaaagtgatcaacaggctatttggacgcacagctgatttgcgataacgaaattcagaggcaatttcgacatcacatggcacacccgctaaagactcaaaccaataacgagaaaccatccctgagttgtaagacgtaccgcaggcaatgatttgaatatgttgaacctctgccaacagggcatcagcttttgggccaagttctgacagatcaatcatcccgtggcttaaacggccttccagcgtattcttaatcgccattggctgttcataaatttctttctgcatgtaatggcggtaaatacctttatcacccgcatcgtattgcacctgagattcgatttcagggcgctcaatagcattcccctgcttatcaaagatagagatgctccggcgagtaacttcaaccacatcaccttcttccaagaagataaaccggcgagtaactggcagtaaagcaagctggtcagaagcaataaagttttcacccacaccgcacccgatcaccagcgggctacctgaacgagcggcaatcagacgacttgggtcacggctatccatcacaacagtaccgtatgcaccgcgtaattgcggaatcacacgtttcacaacttccagcaaagaccccccttgctgctgctcccaatgtactaagtgagcaataacttcggtgtcagtttcagagctaaaacgatagccacggctaattaataattcacgtaacggttcatgattctcaataatgccgttatgcacgacggagatatagtcagaaacatgagggtgtgcattagcctctgacggctccccatgggtagcccagcgggtatgagctatgcccgtgccaccgtgtaaatcctgcttttcagcagcatcagacaaagcatgaaccttacccaccctacgtaaacgagtcaggtgaccttcactatcaactaccgctaaaccagcggagtcatagccacggtattcaaggcgacgtaagccttcgatcagaatctcagcgatatcacgttgcgctactgcgccaacaattccacacatctgttttattcctatgtaaggtcccttattaggaccttttcgatgtcagtgacctgattgatccggattttccgggctccccgagcctgtagagttggggattattatgttttgtactgtattttcagtaaaccaaaaatacagggcaaaacatcccttcaaagaagcataattcaccttgaagggtgcttttaataacgttactttttctttaccgggcgcttccatccctgaatatgaacctgcttaacccggctgatgactaattcattttcggcaacatcacgggtgacagtcgtacccgcgccaatggttgcaccgtttgcaacggtgaccggggcaactaattgagtatccgatccgacaaaaacatcatcgccaataatagttttaaacttattagccccgtcatagttacacgttatagttcccgcgccaatattgacgccagccccaatctcagcgtcacctagataagagagatgaccggctttagagcctttacccaaacgggcttttttgatttcaacaaaattaccaacatgtgcaccttcagccaattcagcgccaggacgcagacgagcaaatggcccaacagtacagttggcatccaggcgggcatcttctaaaacggtatatgggcttatttctgagtcatcaccaatcacacagtttttgagtacacaccccgtaccaattcgcacccggtcacctaaaatcacatgaccttcaataatgacattggtatcgatagtaatatcgcgaccatgagttaattctccgcgcaaatcaaaacgggagggatccaatagcatcacgcccgctaacaataatttttccgcttgttctgtctgaaatacgcgctcaagagcagacaattgcaggcgattattcaccccttccacttcactcaaacgggtaggatggacagtggcaattttcttaccatcggcatgcgctaacgcaataatgtcagtgatataaaactcaccttgagcattattattatccaacaatgatagccagcgttttaaatcgcgcccatttgcgaccagaatccccgtattgatctcgttgatttcccgttgtgcatcgctggcatctttatgttcaacgatcccgacgacatcgccattctcacgaacgatacggccataaccgcttgggttatccagttttactgtcaacaagccaatcccgccctcgggcttagcggccagcagacgttgtagcgtatcaacagagatcagcggcacatcgccatacaacatcaaaatatcttcatcatcagcaaaatgtggggcagcttgctgcatcgcatggccagtacccagttgctcagcctgtaatacccaattcaaggatggatcggccagggtcttcttcagtaactcacccccgtgcccataaaccagatgaacatgttgtgcacctagcttcatggcagcatcaataacatgctgaaccattggcttacctgccaatgggtgcaataccttaggaaggtcggaatacatacgtgtccccttacccgcggcaaggatgacgacactcattgagctgttagacataagcaacctgataactccaatttaatagacggaagtaaacctgtttaccgaaataattactacatatttctcaacgaaaaacgtacacaacccgcgtggctaaagggctgtagtgacttgtcatataaacaaaaaatgcgtaaaaaagtgtcggtgatcggcgacgttttttgccgtttttttgtcaaaatgtattctgttaattaggttaataactacttattttacgacagaaaacaaggattatccgaaagaaattcgataatccttgcttatgatttattgaagattttaaaggattacacatcatatatacccaagttatttcaagatgcaggcgggtaacaaccgagtaaatacccaggagcgtagacaactaagtgactggggtgagcaacccctgcattttgaagggctacgtagatgagggataaaacagtcaaggctgggtggtataagtattaaaaaatgccagtcagttttcaccgactggcattctatcgttacttaataacattatatttcatatggtttaaacgccgaggtttaaaaccttgtgattatctatctgataccgcttaagcagtcacagatagataaacaatacaaaatataacgttacatcgctttcttggttagctcaattacgcgtagtttcgcaatcgccttcgccaattcagcggatgcctgagcatagtcgacatcgccgtgggagttattaatatgggcttctgctttacgcttagattccagcgctcttgcttcgtccagatccagcccacgaatagctgtgtcagccaatacgatcacaacgctcggttgcacctcaaggatgccaccagaaagataaataaactcttcctcaccgaactgtttaacgatacgtatcatgccaggcttgatggcagtgagcagtggggcgtgcccagggaaaatacccagttcaccttcactacccgtcacctgaatcttttgtaccacgcctgagaacattttcttctcggcgctcacaacatccagatggtaagtcattgcagccatgtcaccctccagtcaacagcgttacagtttcttggctttttccactgcttcttcaatggtaccaaccatgtagaacgcctgttccggcaagtggtcatagtcgccattcatgatgcctttgaaaccacgaatggtatctttcagcgacacaaacttgcccggtgaaccggtgaagacttcagccacaaagaacggttgagacaggaagcgctgaatcttacgcgcacgggataccacaagtttgtcatcttctgacaactcgtccatacccaagatcgcgatgatatctttcagctcttggtaacgttgcagaatagactgcacgccacgcgctacatcgtagtgctcctggccaacaaccaacggatcaagctgacggctggtagagtcaagtgggtcaactgctggataaatacccagagaggcgatttgacgactcagaacgacggttgcatccaagtgagcaaaggtggttgctggtgatgggtcagtcaagtcatccgcaggtacataaacggcctgaacagaggtgattgaacccgtcttagtggaagtaatacgttcctgcaacacacccatctcttcagccagtgttggctgataacctaccgctgatggcatacgacccagcaatgcggatacttccgtaccagctagggtataacgatagatattatcgatgaacagcagtacgtcacgaccttcatcacggaatttctccgccatggtcaggccggtcagtgcaacgcgtagacggttacctggtggctcattcatctggccgtaaaccaaggatactttgtccaaaacgttggagtcagtcatttcatggtagaagtcattaccctcacgggtacgctcacctacaccggcaaatacagaatacccagagtgctcgatcgcgatgttacggatcagctccatcatgtttactgttttacctacacccgcaccaccgaacagaccgactttaccgcccttagcaaacggacaaatcaggtccataaccttgataccggtttctaacagatcttgtgagctagcaagctcttcataagaaggcgcttcgcgatggattgcccaacgctcttcttcaccgataggacctttcatgtcgattggttcacccaatacgttcatgatacggccaagggtcgctttaccaaccggtacttcgatcgggtgttccaggttggttactttcaacccacggctcagaccatcggaagagcccattgcgatacaacgaacaacaccaccgcccaactgttgctgaacttccagcactaacttttcagttgtgccttctacctcaagggcgttgtacacttttggtacagcgtcttgggggaattcgacgtccactacggcgccgattacctggataatctttccagtagccatcttgaatcctctacgtaatacgtttacccgccatacttcaaattgctggggcgttggctgccttatctcaccccgacgacttactttataagcgtcagaggatttactcagttgccgccttcccgcaatctgaactatttagggtaataacctggttaaaccgcggaggctcccccgacgatctcggtgagttcctgagtgatgctggcctgacgagccttgttataaactaactgcagctctttgatcaggctaccgccgttatcggtggcggctttcatcgctaccattcgcgcggcctgctcgctggccaggttttcaacgacgccctgataaacttgtgattccacatagcgccgcaagagtgtatccagcagggctttaggatcaggttcatacaagtaatcccaggacttcttcttcagctcgccatcttccgcaggcggaagaggtaacaactgcatgatccgtggttcctgagacattgtgttgataaacttgttattgactatatacagcttatccagacgaccttcatcataggcttgcagcatgactttcaccggcccgatcagttctgacaacgaggggttatcccccatgccagtcacttgagcgacaatcttgccgcctacggaaccaaagaaagaggctgcttttgatccgatcagcgctaaatcacattcaacgcctttttcagaccaacctttcatctcagccaacagtcttttgaacaagttaatgttcaaaccaccgcacaagccacggtctgtcgaaaccaccagatacccaacgcgcttaacgtcacgttcttccaggtacggatgtttatattccagattacctaacgcgaggtgaccaatcacactacgcattgtttctgcataaggacggctggccgccatgcgttcctgcgacttacgcattttggaggcggcgaccatctccatggctttggtgatcttttgcgtgttttgcacgctggcgatcttggaacgtatctcttttgcgccggccatttctgcttctcctcattaccagacggcctgctttcctaacgaaaagcaggaccgcatagcgttaccaggactgggttgccttaaatgtatcgaggatgcctttcagcttggcctcgatctcatcgttatacgcgccagtttggttgatttgttgcagaagctcagcatgctcacggtcagcaaatgccaacagtgcagcttcaaagctacccaccttcgccaactcgacatcacccagataaccacgttcagctgcgaacagaaccagagactgctgtgcaaccgacatcggcgcatattgtttctgtttcagaagctcggtcactttctgaccatggctcagctgtttacgtgttgcatcatccaaatcggatgcgaactgggagaacgctgcaagctcacgatactgtgccagagcggtacgaataccaccggacagttttttcatgatcttggtctgcgctgcaccacccacacgggatacggagatacctgggttaacggcaggacgaataccggcgttaaacaggctggattccaggaagatctgaccatctgtaatcgatattacgttggtcggaacaaacgcagaaacgtcacctgcctgagtttcaatgataggtaatgcggttaaagaacctgttttacctttcacttcacccttggtaaaggcctcaacatactcagcgtttacacgcgcagcacgctccaacaaacgggagtggaggtagaatacgtcgccaggataggcttcacgacctggtggacgacgaagcagcaaggagatttgacgatatgcaacagcctgtttagacaggtcatcataaataatcagcgcatcctcaccgcgatcacggaaatattcacccatggcacaaccggagtaaggtgccagatactgcaatgctgcagattctgatgcagtagcaacaaccacaatggtgttagctaatgcgtcatgttcttccagcttgcgcactacgtttgcaacagtagaagctttctggccgatagcaacatacacacatttaatgccggaatcgcgttggttgatgatcgcatcaatcgccagtgcagttttacctgtctgacggtcaccgatgatcaattcacgctgaccacgaccaattgggatcatggcatcgacggatttatagcccgtctgaacaggctcatcaacggattgacgttcgataacaccaggtgcgatagcttcaacagctgagaagccgtcgttttctatagaacctttaccatcaataggttcacccagagtattgacgacacgccccaacaggccacgaccgacaggaacttccaggatacggccagtacatttaaccttcatgccttcggcaagatcggcgtacggacccataactacagcacctacggagtcgcgctccaagttcagtgcgattgcgtaacggttgcctggcagtgcgatcatctcaccctgcataacatcggccagaccgtgtacacgaatgatcccgtcactaacggaaacaatagtaccttcattgtgagcttcgctcactacattgaactgagcaatgcgctgcttgatcagttcgctgatttcggtggaattcagttgcatatgctccagtccccttaagactgcaagacgtctgccaggcgttcaagacgaccgcgaacgctgccatctatcaccatatcgcctgcacgtattactacgccggccattacagacttatcaattttgcaattcagcttaactttgcgtgacagacgtttttccatcgcagcagcaattttcgctagctgttcgtcgttaagtgctctcgcagaggacacttcaacgtcgacggtagactccaatgaggcacgcagttgaataaactgctgtaacacctcaggaagaaccagtaaacggccattctccgccataactcgaatgaagttctgtgcgggctcatcgagctgatcaccacagactgcaataaacgtcgtcgacattgtctctggcgctacagcaccggaaagtaattcagcgatctgttcattgcgagtcacttgggcagtaaacgccagcatattctgccaacgctcaactgcctggtgctcaacagcaaagtcaaaagctgctttggcgtaggggcgagctacagttacaaattcagacatcagcccctccctccttacagttcagcgaccagtttatcaacgatgtcgctgttagcagcttcatccacggaacgttcgatgatcttctcggcgccagctatagccaacatcgcgacttgcttacgcaactcttcacgagcgcgcttacgttcggcgtcgatctctgcctgcgcttgcgccacgattttgttacgttcctgttcagcttctgctttagcttcatcaaggatctgagctttgcgtttacttgcttgctcaatgatcacctgtgcctctgctttggctttcttcagttggtcggtcgcattggcttgcgctaagtccaaatcttttttggcacgctctgcagaagagagaccgtcagcaatttcttgttgacgcttctcgatagcagccataattggcggccatacatacttcatacaaaatatgacaaacaggacaaacgcgatggcctggccgaggattgttgcgttaagattcacagcacaatgcctctttaaaagttaatagtttggtgtagtttcaccgtagagaaaactctacttacgcgacagcaaacatcacgtacagacccagaccaacagcgatcatagggatggcgtcaaccaggcccatgacgataaagaactgtgtacgcagcagaggaatcaggtcaggctgacgtgcagcgccttccaaaaatttaccacccaggatgccgataccaatcgcagcaccgattgccgctaaacccatcatcacagcggcagccatgtacagcagatccatattcaggttttccatgacagtctccagtttatttcagttaaaacgcagtagtgttataagaaaatcagtgctcttcggatgccatcgagagatagacaatcgtcagaaccatgaagataaaggcttgtaacgtaatgatcaggatgtggaatatagcccaaggaacactgagcatccactgtgaccaccacggcaacagacccgcaatcaggatgaagatcaactcacccgcatacatgttgccgaacagtcgcagacccaatgaaagcggtttggacagcaggctgacaccttccagaattaagtttactggaatgaatatcgggtgattgaacggctgcatagttaattcttttgtgaagccgcctacacctttcattttaatgctatagaaaataatcaggatgaaaacacccaatgccatagacaacgtaatgctcacgtcagctgtaggtaccacacgcagtgctggtaacccaaagacatgttcaccgatgtaaggcagtaaatcgattggcagtaaatccatcatgttcatcaataaaacccaaacaaagactgttagggctaatggtgcgatgactttacttttgccgtgatacatatcccgcacactgttatcgacaaaaccgataattaactctacagcagtctgcaatttaccgggtacgccactggtggcgcttgcagcaactttgcggaacacaagcagaaaagctaaccccagcacgacagagaagaacaaagagtcaatgttcaacgtccagaacgttgcagggccagttgagtggggattgaccaactcaaaggtacgcaggtccaactgaaggtgattcaggtggtgacctatgtagtcccttggagtagagatttctcctgatgcagacatgatgcctcttacccttgttgtagttaaatacgataactgttaagtacggtgaccgttaatcacggccggtgctaaaatctgcacaatcagcaccgataaataggttaaaccaagtgggacaaatgcggctttaaacagccctaacgccacaatcagtaaagctatcgtaaggataacttttaacccttcgccaatggcgaacgaccacgcaacacgacccggagctgctgtttttgcctgatggcggcaagcaaacagcataaacatggcactaggtaaccaggctgccaacccccctgccagagcagaaacactccattccaggcttttaatgccaaaaactgcgctgagaacaacaaaagtcattaactgcaaaaacagtaactttcgtgcaattttcccactgtaaagggatacaggcatgacgtttgttctctccgaaccacaccagggtatgctgagtgaggtatgaaactgcctttctcccattgagtcaagcagcgaaaaacgagcaaattatacgggccactcaaacgaattcaatcgataagtagcgaaaaggtgaacaattatttaaattttattcttttggcttattttcacaagaaaagcctcggaataaagctctcattttattgtcttactattccaataatagtcataaaaacgtgaaatacatcacataaataaaaacaaaacgatttataacctataaagccttgctttgtctttaacgaaaagagcctttaaaatattttataaatcataatgttaaaatcaaactctttctaaaacaacttatctacttagtgaaaacttaccattgacatttcagataataatttcataacaataaagatacataaaaagagtggtagccaaccaaaagtaattaccaaagtgattatttaactacttacaatgtttttatgctcactttcacctctttttttgtaaaaaaaaggtgaaaaataattttcctaaacaacagtgagcaaataaagatctccccatgctggaaacaatgaactcaataagtttactaacgactactaataatttgttgcctttttttgataaaaagcaaagttagtttgacttaagaataatcaaatgccgctctccatccaattcgggaacatccagttttatcaccgactcaagaacaatatcttcgggcagaaccgctaactcatcatcaggccgaacccctttaagcgcataaaaacgcccttcaggcttagctggcaagtggtgacaccacgagagcatatcttgtaaggatgcaaatgcacggcttatcacaccatcaaatggcggttctgaggtaaatgcctcaactctgctctgaaccggctcaatgttatttaaccccagttcgtgttgcacctgacgtagaaagcgaacccgcttacccaggctatccaacaaagtaaaatgtgcatcagggcgcacaatagccaaagggataccaggaagacctggcccggttccgacatcaataaatcggctgccttgcagatggggattaaccacaatgctatcaaggatatgacgcactaacatttgctgtggatcacgaacagatgtcaggttataagctttattccacttgtctagcagctctacatagccaatcaactgatgtttttgctgatcgggtaacgtaataccagcaacggtaagcagagagtctaatttttttaacacaagggtatcctctgaccagaaaacgcccagtcagcatataaatgggtcaataggcaaaatgataatccagcatggtaatggattgaatatgtttactgtatttgcctgaccgtaaaatacagggtgcaggcaaacgtttaatcgtcacgcactgcggcgcaacaaaccttgttttttcagccaaaccagtaagatagatattgccgcgggggtaatacctgaaattcgggatgcctgaccaattgaactgggtttatggtcattcaatttggcaatgacttcattcgacaaacctgagacttgctgataatcgagatcaacgggcaataaggtattttcgttacgtagttgtttttcgatctcttcctgctgacgagtaatatacccttcatatttgacttgaatttcaacttgatcagccgattgtggatcagtcaacgctgggccaaatgatgtcaaagaggtcaacaaacgatagtctatttcaggccgacgcagtagctcttctccgttggcttctttggacaaaggtgctttcagcagcgcattgatctctgaaacattctcagaatgcgggtgcacccagatatcacgcagccgttggcgctctttttcaatttgttcaactttttggctgaaatgtgcccaccggatatcatccactaatcccaatttgcggcctgtttcagtcaggcgtagatcagcgttatcttcacgcagcatcaaacggtattcagctctggaggtaaacatacggtacggttctttagtgccgagagtgcttaaatcgtccaccagcacgccaaggtaagcttcatcacgccgaggtgaccatccgtcctcctcgttggcaaaacggcccgcattaagccctgcaagcagcccttgagccgcagcttcctcgtagcccgttgtgccattgatttgtcccgcaaagaacaagccttgaatatatttactttccagagtcggttttaaatcgcgaggatcaaagaaatcatattcgatagcatagccgggacgaataatacgtgcattttccaaccctttcattgagcggacaatttgcatctgtacatcgaaaggcaaactggtagaaatgccgttcggatagatctcgttactggttagcccctctggttcgaggaagatctgatgtgaattacgatcagcaaaacgcatgactttatcttcgatcgatgggcagtaacgtgggccgatcccttcgatgatccctgcatacattgggctgcgatccaggttattgcggatcacttcatgtgttttttcattggtgtaggtgatatgacaagccatttgttcaggatgttgttcagcatttcccaagaaagagaatactggaattggcgtatcacccaactgaggtgttaattggctaaagtcgatagttcgcgcatcgatacgtggtggagtgcccgttttaaggcgatttactcgcaaaggcagttcacgtaagcgttgtgataatgagatcgaagggggatcaccggcacggccaccactgtaattttctagcccaatatgtattttgccatcaaggaaggtaccaacagttagcaccaccgctttggcacggaatttcagacccatttgtgtgactgcgccaacgacacgatcattttcaacaatgagatcttcaacaggttgctggaagatcatcaagttaggttgattctccaatgccgttcgtaccgctaaacgatacagaacacggtcagcctgagcgcgggttgctcttaccgcaggccctttgctggcgtttagtatcctaaactggatccccgcgaggtctgttgctttcgccatcaggccacccagagcatcaatttctttgaccaagtgccccttgccgataccgccgattgctgggttacaagacatttgccccagagtatcgatattgtgcgtcagcaataaggtctgacgtcccatgcgtgccgcggccatggcggcttcggtgcctgcatggccaccaccgatgatgatgacgtcaaattgatctggataaaacatggtactgcacctcgccgttatgcgaatttctgtgtttgccctggggtgggggattctactcaagtttagacgatcgaccaagtggcataggatcgcctttaattaaaagaa
